US011951186B2

(12) United States Patent
Krishnamani et al.

(10) Patent No.: US 11,951,186 B2
(45) Date of Patent: Apr. 9, 2024

(54) INDICATOR COMPOUNDS, DEVICES COMPRISING INDICATOR COMPOUNDS, AND METHODS OF MAKING AND USING THE SAME

(71) Applicant: Cercacor Laboratories, Inc., Irvine, CA (US)

(72) Inventors: Venkatramanan Krishnamani, Irvine, CA (US); Sergei Petrovich Balashov, Irvine, CA (US); Kevin Hughes Pauley, Lake Forest, CA (US); Ruiqi Long, Irvine, CA (US); Hung The Vo, Fountain Valley, CA (US)

(73) Assignee: Willow Laboratories, Inc., Irvine, CA (US)

( * ) Notice: Subject to any disclaimer, the term of this patent is extended or adjusted under 35 U.S.C. 154(b) by 575 days.

(21) Appl. No.: 17/078,843

(22) Filed: Oct. 23, 2020

(65) Prior Publication Data

US 2021/0121582 A1    Apr. 29, 2021

Related U.S. Application Data

(60) Provisional application No. 63/019,126, filed on May 1, 2020, provisional application No. 62/926,323, filed on Oct. 25, 2019.

(51) Int. Cl.
*A61B 5/1455* (2006.01)
*A61B 5/1459* (2006.01)
(Continued)

(52) U.S. Cl.
CPC ........ *A61K 49/0056* (2013.01); *A61B 5/1455* (2013.01); *A61B 5/1459* (2013.01);
(Continued)

(58) Field of Classification Search
CPC . A61B 5/1455; A61B 5/1459; A61B 5/14532; A61B 5/14535
See application file for complete search history.

(56) References Cited

U.S. PATENT DOCUMENTS 4,960,128 A    10/1990   Gordon et al.
4,964,408 A    10/1990   Hink et al.
(Continued)

FOREIGN PATENT DOCUMENTS

CA    2352571    2/2007
CA    2336985    1/2011
(Continued)

OTHER PUBLICATIONS

Admelog (insulin lispro injection), for subcutaneous or intravenous Prescribing Information, Dec. 2017 Revision (in 42 pages).
(Continued)

*Primary Examiner* — Marjan Fardanesh
(74) *Attorney, Agent, or Firm* — Knobbe Martens Olson & Bear LLP

(57) ABSTRACT

Some embodiments disclosed herein pertain to indicator compounds used to detect the presence of and/or an amount of an analyte. In some embodiments, the indicator compounds are fusion proteins. In some embodiments, when the analyte binds to the indicator compound, the indicator compound undergoes a conformational change. In some embodiments, the conformational change results in a luminescent signal that allows quantification of the amount of analyte present.

17 Claims, 71 Drawing Sheets

Specification includes a Sequence Listing.

(51) Int. Cl.
   *A61B 5/1473* (2006.01)
   *A61B 5/1477* (2006.01)
   *A61K 49/00* (2006.01)
   *C07K 14/245* (2006.01)
   *C07K 14/435* (2006.01)
   *A61B 5/145* (2006.01)

(52) U.S. Cl.
   CPC ........ *A61B 5/14735* (2013.01); *A61B 5/1477* (2013.01); *A61K 49/0045* (2013.01); *C07K 14/245* (2013.01); *C07K 14/43595* (2013.01); *A61B 5/14532* (2013.01); *C07K 2319/20* (2013.01); *C07K 2319/60* (2013.01)

(56) References Cited

U.S. PATENT DOCUMENTS

| | | |
|---|---|---|
| 5,319,355 A | 6/1994 | Russek |
| 5,337,744 A | 8/1994 | Branigan |
| 5,341,805 A | 8/1994 | Stavridi et al. |
| D353,195 S | 12/1994 | Savage et al. |
| D353,196 S | 12/1994 | Savage et al. |
| 5,377,676 A | 1/1995 | Vari et al. |
| D359,546 S | 6/1995 | Savage et al. |
| 5,431,170 A | 7/1995 | Mathews |
| 5,436,499 A | 7/1995 | Namavar et al. |
| D361,840 S | 8/1995 | Savage et al. |
| D362,063 S | 9/1995 | Savage et al. |
| D363,120 S | 10/1995 | Savage et al. |
| 5,456,252 A | 10/1995 | Vari et al. |
| 5,474,978 A | 12/1995 | Bakaysa et al. |
| 5,479,934 A | 1/1996 | Imran |
| 5,482,036 A | 1/1996 | Diab et al. |
| 5,494,043 A | 2/1996 | O'Sullivan et al. |
| 5,514,646 A | 5/1996 | Chance et al. |
| 5,533,511 A | 7/1996 | Kaspari et al. |
| 5,561,275 A | 10/1996 | Savage et al. |
| 5,590,649 A | 1/1997 | Caro et al. |
| 5,602,924 A | 2/1997 | Durand et al. |
| 5,638,816 A | 6/1997 | Kiani-Azarbayjany et al. |
| 5,638,818 A | 6/1997 | Diab et al. |
| 5,645,440 A | 7/1997 | Tobler et al. |
| 5,671,914 A | 9/1997 | Kalkhoran et al. |
| 5,700,662 A | 12/1997 | Chance et al. |
| 5,726,440 A | 3/1998 | Kalkhoran et al. |
| D393,830 S | 4/1998 | Tobler et al. |
| 5,743,262 A | 4/1998 | Lepper, Jr. et al. |
| 5,747,806 A | 5/1998 | Khalil et al. |
| 5,750,994 A | 5/1998 | Schlager |
| 5,758,644 A | 6/1998 | Diab et al. |
| 5,760,910 A | 6/1998 | Lepper, Jr. et al. |
| 5,890,929 A | 4/1999 | Mills et al. |
| 5,919,134 A | 7/1999 | Diab |
| 5,987,343 A | 11/1999 | Kinast |
| 5,997,343 A | 12/1999 | Mills et al. |
| 6,002,952 A | 12/1999 | Diab et al. |
| 6,010,937 A | 1/2000 | Karam et al. |
| 6,027,452 A | 2/2000 | Flaherty et al. |
| 6,040,578 A | 3/2000 | Malin et al. |
| 6,066,204 A | 5/2000 | Haven |
| 6,115,673 A | 9/2000 | Malin et al. |
| 6,124,597 A | 9/2000 | Shehada et al. |
| 6,128,521 A | 10/2000 | Marro et al. |
| 6,129,675 A | 10/2000 | Jay |
| 6,144,868 A | 11/2000 | Parker |
| 6,152,754 A | 11/2000 | Gerhardt et al. |
| 6,184,521 B1 | 2/2001 | Coffin, IV et al. |
| 6,232,609 B1 | 5/2001 | Snyder et al. |
| 6,241,683 B1 | 6/2001 | Macklem et al. |
| 6,253,097 B1 | 6/2001 | Aronow et al. |
| 6,255,708 B1 | 7/2001 | Sudharsanan et al. |
| 6,280,381 B1 | 8/2001 | Malin et al. |
| 6,285,896 B1 | 9/2001 | Tobler et al. |
| 6,308,089 B1 | 10/2001 | von der Ruhr et al. |
| 6,317,627 B1 | 11/2001 | Ennen et al. |
| 6,321,100 B1 | 11/2001 | Parker |
| 6,334,065 B1 | 12/2001 | Al-Ali et al. |
| 6,360,114 B1 | 3/2002 | Diab et al. |
| 6,368,283 B1 | 4/2002 | Xu et al. |
| 6,400,974 B1 | 6/2002 | Lesho |
| 6,411,373 B1 | 6/2002 | Garside et al. |
| 6,415,167 B1 | 7/2002 | Blank et al. |
| 6,430,437 B1 | 8/2002 | Marro |
| 6,430,525 B1 | 8/2002 | Weber et al. |
| 6,463,311 B1 | 10/2002 | Diab |
| 6,470,199 B1 | 10/2002 | Kopotic et al. |
| 6,485,703 B1 | 11/2002 | Cotéet al. |
| 6,487,429 B2 | 11/2002 | Hockersmith et al. |
| 6,505,059 B1 | 1/2003 | Kollias et al. |
| 6,525,386 B1 | 2/2003 | Mills et al. |
| 6,526,300 B1 | 2/2003 | Kiani et al. |
| 6,534,012 B1 | 3/2003 | Hazen et al. |
| 6,542,764 B1 | 4/2003 | Al-Ali et al. |
| 6,580,086 B1 | 6/2003 | Schulz et al. |
| 6,584,336 B1 | 6/2003 | Ali et al. |
| 6,587,196 B1 | 7/2003 | Stippick et al. |
| 6,587,199 B1 | 7/2003 | Luu |
| 6,595,316 B2 | 7/2003 | Cybulski et al. |
| 6,597,932 B2 | 7/2003 | Tian et al. |
| 6,606,511 B1 | 8/2003 | Ali et al. |
| 6,635,559 B2 | 10/2003 | Greenwald et al. |
| 6,639,668 B1 | 10/2003 | Trepagnier |
| 6,640,116 B2 | 10/2003 | Diab |
| 6,640,117 B2 | 10/2003 | Makarewicz et al. |
| 6,658,276 B2 | 12/2003 | Kiani et al. |
| 6,661,161 B1 | 12/2003 | Lanzo et al. |
| 6,697,656 B1 | 2/2004 | Al-Ali |
| 6,697,658 B2 | 2/2004 | Al-Ali |
| RE38,476 E | 3/2004 | Diab et al. |
| RE38,492 E | 4/2004 | Diab et al. |
| 6,738,652 B2 | 5/2004 | Mattu et al. |
| 6,760,607 B2 | 7/2004 | Al-Ali |
| 6,788,965 B2 | 9/2004 | Ruchti et al. |
| 6,794,195 B2 | 9/2004 | Colvin, Jr. |
| 6,816,241 B2 | 11/2004 | Grubisic |
| 6,822,564 B2 | 11/2004 | Al-Ali |
| 6,850,787 B2 | 2/2005 | Weber et al. |
| 6,850,788 B2 | 2/2005 | Al-Ali |
| 6,876,931 B2 | 4/2005 | Lorenz et al. |
| 6,920,345 B2 | 7/2005 | Al-Ali et al. |
| 6,934,570 B2 | 8/2005 | Kiani et al. |
| 6,943,348 B1 | 9/2005 | Coffin IV |
| 6,956,649 B2 | 10/2005 | Acosta et al. |
| 6,961,598 B2 | 11/2005 | Diab |
| 6,970,792 B1 | 11/2005 | Diab |
| 6,985,764 B2 | 1/2006 | Mason et al. |
| 6,990,364 B2 | 1/2006 | Ruchti et al. |
| 6,998,247 B2 | 2/2006 | Monfre et al. |
| 7,003,338 B2 | 2/2006 | Weber et al. |
| 7,015,451 B2 | 3/2006 | Dalke et al. |
| 7,022,674 B2 | 4/2006 | DeFelippis et al. |
| 7,027,849 B2 | 4/2006 | Al-Ali |
| 7,060,503 B2 | 6/2006 | Colvin, Jr. |
| D526,719 S | 8/2006 | Richie, Jr. et al. |
| 7,096,052 B2 | 8/2006 | Mason et al. |
| 7,096,054 B2 | 8/2006 | Abdul-Hafiz et al. |
| D529,616 S | 10/2006 | Deros et al. |
| 7,133,710 B2 | 11/2006 | Acosta et al. |
| 7,142,901 B2 | 11/2006 | Kiani et al. |
| 7,157,723 B2 | 1/2007 | Colvin et al. |
| 7,190,445 B2 | 3/2007 | Colvin, Jr. et al. |
| 7,225,006 B2 | 5/2007 | Al-Ali et al. |
| RE39,672 E | 6/2007 | Shehada et al. |
| 7,227,156 B2 | 6/2007 | Colvin, Jr. et al. |
| 7,254,429 B2 | 8/2007 | Schurman et al. |
| 7,254,431 B2 | 8/2007 | Al-Ali et al. |
| 7,254,434 B2 | 8/2007 | Schulz et al. |
| 7,274,955 B2 | 9/2007 | Kiani et al. |
| D554,263 S | 10/2007 | Al-Ali et al. |
| 7,280,858 B2 | 10/2007 | Al-Ali et al. |
| 7,289,835 B2 | 10/2007 | Mansfield et al. |
| 7,292,883 B2 | 11/2007 | De Felice et al. |
| 7,341,559 B2 | 3/2008 | Schulz et al. |
| 7,343,186 B2 | 3/2008 | Lamego et al. |

(56) References Cited

U.S. PATENT DOCUMENTS

| | | |
|---|---|---|
| D566,282 S | 4/2008 | Al-Ali et al. |
| 7,356,365 B2 | 4/2008 | Schurman |
| 7,371,981 B2 | 5/2008 | Abdul-Hafiz |
| 7,373,193 B2 | 5/2008 | Al-Ali et al. |
| 7,375,347 B2 | 5/2008 | Colvin, Jr. et al. |
| 7,377,794 B2 | 5/2008 | Al-Ali et al. |
| 7,395,158 B2 | 7/2008 | Monfre et al. |
| 7,405,387 B2 | 7/2008 | Colvin, Jr. et al. |
| 7,415,297 B2 | 8/2008 | Al-Ali et al. |
| 7,438,683 B2 | 10/2008 | Al-Ali et al. |
| 7,452,860 B2 | 11/2008 | Boderke |
| 7,483,729 B2 | 1/2009 | Al-Ali et al. |
| D587,657 S | 3/2009 | Al-Ali et al. |
| 7,500,950 B2 | 3/2009 | Al-Ali et al. |
| 7,509,494 B2 | 3/2009 | Al-Ali |
| 7,510,849 B2 | 3/2009 | Schurman et al. |
| 7,514,725 B2 | 4/2009 | Wojtczuk et al. |
| 7,519,406 B2 | 4/2009 | Blank et al. |
| D592,507 S | 5/2009 | Wachman et al. |
| 7,530,942 B1 | 5/2009 | Diab |
| 7,593,230 B2 | 9/2009 | Abul-Haj et al. |
| 7,596,398 B2 | 9/2009 | Al-Ali et al. |
| 7,606,608 B2 | 10/2009 | Blank et al. |
| 7,620,674 B2 | 11/2009 | Ruchti et al. |
| D606,659 S | 12/2009 | Kiani et al. |
| 7,629,039 B2 | 12/2009 | Eckerbom et al. |
| 7,640,140 B2 | 12/2009 | Ruchti et al. |
| 7,647,083 B2 | 1/2010 | Al-Ali et al. |
| D609,193 S | 2/2010 | Al-Ali et al. |
| D614,305 S | 4/2010 | Al-Ali et al. |
| 7,697,966 B2 | 4/2010 | Monfre et al. |
| 7,698,105 B2 | 4/2010 | Ruchti et al. |
| RE41,317 E | 5/2010 | Parker |
| RE41,333 E | 5/2010 | Blank et al. |
| 7,713,745 B2 | 5/2010 | Colvin, Jr. et al. |
| 7,718,353 B2 | 5/2010 | Tolosa et al. |
| 7,729,733 B2 | 6/2010 | Al-Ali et al. |
| 7,761,127 B2 | 7/2010 | Al-Ali et al. |
| 7,764,982 B2 | 7/2010 | Dalke et al. |
| D621,516 S | 8/2010 | Kiani et al. |
| 7,791,155 B2 | 9/2010 | Diab |
| 7,800,078 B2 | 9/2010 | Colvin, Jr. et al. |
| 7,822,450 B2 | 10/2010 | Colvin, Jr. et al. |
| RE41,912 E | 11/2010 | Parker |
| 7,851,225 B2 | 12/2010 | Colvin, Jr. et al. |
| 7,880,626 B2 | 2/2011 | Al-Ali et al. |
| 7,909,772 B2 | 3/2011 | Popov et al. |
| 7,919,713 B2 | 4/2011 | Al-Ali et al. |
| 7,937,128 B2 | 5/2011 | Al-Ali |
| 7,937,129 B2 | 5/2011 | Mason et al. |
| 7,939,332 B2 | 5/2011 | Colvin, Jr. |
| 7,941,199 B2 | 5/2011 | Kiani |
| 7,957,780 B2 | 6/2011 | Lamego et al. |
| 7,962,188 B2 | 6/2011 | Kiani et al. |
| 7,976,472 B2 | 7/2011 | Kiani |
| 7,990,382 B2 | 8/2011 | Kiani |
| 8,008,088 B2 | 8/2011 | Bellott et al. |
| RE42,753 E | 9/2011 | Kiani-Azarbayjany et al. |
| 8,028,701 B2 | 10/2011 | Al-Ali et al. |
| 8,048,040 B2 | 11/2011 | Kiani |
| 8,050,728 B2 | 11/2011 | Al-Ali et al. |
| RE43,169 E | 2/2012 | Parker |
| 8,118,620 B2 | 2/2012 | Al-Ali et al. |
| 8,130,105 B2 | 3/2012 | Al-Ali et al. |
| 8,143,068 B2 | 4/2012 | Colvin, Jr. et al. |
| 8,182,443 B1 | 5/2012 | Kiani |
| 8,190,223 B2 | 5/2012 | Al-Ali et al. |
| 8,203,438 B2 | 6/2012 | Kiani et al. |
| 8,203,704 B2 | 6/2012 | Merritt et al. |
| 8,219,172 B2 | 7/2012 | Schurman et al. |
| 8,224,411 B2 | 7/2012 | Al-Ali et al. |
| 8,229,532 B2 | 7/2012 | Davis |
| 8,233,955 B2 | 7/2012 | Al-Ali et al. |
| 8,255,026 B1 | 8/2012 | Al-Ali |
| 8,265,723 B1 | 9/2012 | McHale et al. |
| 8,274,360 B2 | 9/2012 | Sampath et al. |
| 8,280,473 B2 | 10/2012 | Al-Ali |
| 8,315,683 B2 | 11/2012 | Al-Ali et al. |
| RE43,860 E | 12/2012 | Parker |
| 8,346,330 B2 | 1/2013 | Lamego |
| 8,353,842 B2 | 1/2013 | Al-Ali et al. |
| 8,355,766 B2 | 1/2013 | MacNeish, III et al. |
| 8,374,665 B2 | 2/2013 | Lamego |
| 8,388,353 B2 | 3/2013 | Kiani et al. |
| 8,401,602 B2 | 3/2013 | Kiani |
| 8,414,499 B2 | 4/2013 | Al-Ali et al. |
| 8,418,524 B2 | 4/2013 | Al-Ali |
| 8,428,967 B2 | 4/2013 | Olsen et al. |
| 8,430,817 B1 | 4/2013 | Al-Ali et al. |
| 8,437,825 B2 | 5/2013 | Dalvi et al. |
| 8,455,290 B2 | 6/2013 | Siskavich |
| 8,457,707 B2 | 6/2013 | Kiani |
| 8,471,713 B2 | 6/2013 | Poeze et al. |
| 8,473,020 B2 | 6/2013 | Kiani et al. |
| 8,502,167 B2 | 8/2013 | Colvin, Jr. et al. |
| 8,509,867 B2 | 8/2013 | Workman et al. |
| 8,515,509 B2 | 8/2013 | Bruinsma et al. |
| 8,523,781 B2 | 9/2013 | Al-Ali |
| D692,145 S | 10/2013 | Al-Ali et al. |
| 8,571,617 B2 | 10/2013 | Reichgott et al. |
| 8,571,618 B1 | 10/2013 | Lamego et al. |
| 8,571,619 B2 | 10/2013 | Al-Ali et al. |
| 8,577,431 B2 | 11/2013 | Lamego et al. |
| 8,584,345 B2 | 11/2013 | Al-Ali et al. |
| 8,588,880 B2 | 11/2013 | Abdul-Hafiz et al. |
| 8,630,691 B2 | 1/2014 | Lamego et al. |
| 8,641,631 B2 | 2/2014 | Sierra et al. |
| 8,652,060 B2 | 2/2014 | Al-Ali |
| 8,666,468 B1 | 3/2014 | Al-Ali |
| 8,670,811 B2 | 3/2014 | O'Reilly |
| RE44,823 E | 4/2014 | Parker |
| RE44,875 E | 4/2014 | Kiani et al. |
| 8,688,183 B2 | 4/2014 | Bruinsma et al. |
| 8,690,799 B2 | 4/2014 | Telfort et al. |
| 8,702,627 B2 | 4/2014 | Telfort et al. |
| 8,712,494 B1 | 4/2014 | MacNeish, III et al. |
| 8,715,206 B2 | 5/2014 | Telfort et al. |
| 8,723,677 B1 | 5/2014 | Kiani |
| 8,740,792 B1 | 6/2014 | Kiani et al. |
| 8,755,535 B2 | 6/2014 | Telfort et al. |
| 8,755,872 B1 | 6/2014 | Marinow |
| 8,764,671 B2 | 7/2014 | Kiani |
| 8,768,423 B2 | 7/2014 | Shakespeare et al. |
| 8,771,204 B2 | 7/2014 | Telfort et al. |
| 8,781,544 B2 | 7/2014 | Al-Ali et al. |
| 8,790,268 B2 | 7/2014 | Al-Ali |
| 8,801,613 B2 | 8/2014 | Al-Ali et al. |
| 8,821,397 B2 | 9/2014 | Al-Ali et al. |
| 8,821,415 B2 | 9/2014 | Al-Ali et al. |
| 8,830,449 B1 | 9/2014 | Lamego et al. |
| 8,840,549 B2 | 9/2014 | Al-Ali et al. |
| 8,852,094 B2 | 10/2014 | Al-Ali et al. |
| 8,852,994 B2 | 10/2014 | Wojtczuk et al. |
| 8,897,847 B2 | 11/2014 | Al-Ali |
| 8,911,377 B2 | 12/2014 | Al-Ali |
| 8,989,831 B2 | 3/2015 | Al-Ali et al. |
| 8,998,809 B2 | 4/2015 | Kiani |
| 9,066,666 B2 | 6/2015 | Kiani |
| 9,066,680 B1 | 6/2015 | Al-Ali et al. |
| 9,095,316 B2 | 8/2015 | Welch et al. |
| 9,106,038 B2 | 8/2015 | Telfort et al. |
| 9,107,625 B2 | 8/2015 | Telfort et al. |
| 9,131,881 B2 | 9/2015 | Diab et al. |
| 9,138,180 B1 | 9/2015 | Coverston et al. |
| 9,153,112 B1 | 10/2015 | Kiani et al. |
| 9,192,329 B2 | 11/2015 | Al-Ali |
| 9,192,351 B2 | 11/2015 | Telfort et al. |
| 9,195,385 B2 | 11/2015 | Al-Ali et al. |
| 9,211,095 B1 | 12/2015 | Al-Ali |
| 9,218,454 B2 | 12/2015 | Kiani et al. |
| 9,245,668 B1 | 1/2016 | Vo et al. |
| 9,267,572 B2 | 2/2016 | Barker et al. |
| 9,277,880 B2 | 3/2016 | Poeze et al. |
| 9,307,928 B1 | 4/2016 | Al-Ali et al. |

(56) References Cited

U.S. PATENT DOCUMENTS

| | | |
|---|---|---|
| 9,323,894 B2 | 4/2016 | Kiani |
| D755,392 S | 5/2016 | Hwang et al. |
| 9,326,712 B1 | 5/2016 | Kiani |
| 9,392,945 B2 | 7/2016 | Al-Ali et al. |
| 9,408,542 B1 | 8/2016 | Kinast et al. |
| 9,414,775 B2 | 8/2016 | Colvin, Jr. et al. |
| 9,436,645 B2 | 9/2016 | Al-Ali et al. |
| 9,445,759 B1 | 9/2016 | Lamego et al. |
| 9,474,474 B2 | 10/2016 | Lamego et al. |
| 9,480,435 B2 | 11/2016 | Olsen |
| 9,498,156 B2 | 11/2016 | Whitehurst et al. |
| 9,510,779 B2 | 12/2016 | Poeze et al. |
| 9,517,024 B2 | 12/2016 | Kiani et al. |
| 9,532,722 B2 | 1/2017 | Lamego et al. |
| 9,560,996 B2 | 2/2017 | Kiani |
| 9,579,039 B2 | 2/2017 | Jansen et al. |
| 9,622,692 B2 | 4/2017 | Lamego et al. |
| D788,312 S | 5/2017 | Al-Ali et al. |
| 9,649,054 B2 | 5/2017 | Lamego et al. |
| 9,681,824 B2 | 6/2017 | Colvin, Jr. et al. |
| 9,693,714 B2 | 7/2017 | DeHennis et al. |
| 9,697,928 B2 | 7/2017 | Al-Ali et al. |
| 9,717,413 B2 | 8/2017 | Colvin et al. |
| 9,717,458 B2 | 8/2017 | Lamego et al. |
| 9,724,016 B1 | 8/2017 | Al-Ali et al. |
| 9,724,024 B2 | 8/2017 | Al-Ali |
| 9,724,025 B1 | 8/2017 | Kiani et al. |
| 9,743,869 B2 | 8/2017 | Caban |
| 9,749,232 B2 | 8/2017 | Sampath et al. |
| 9,750,442 B2 | 9/2017 | Olsen |
| 9,750,461 B1 | 9/2017 | Telfort |
| 9,775,545 B2 | 10/2017 | Al-Ali et al. |
| 9,778,079 B1 | 10/2017 | Al-Ali et al. |
| 9,778,190 B2 | 10/2017 | Huffstetler et al. |
| 9,782,077 B2 | 10/2017 | Lamego et al. |
| 9,787,568 B2 | 10/2017 | Lamego et al. |
| 9,808,188 B1 | 11/2017 | Perea et al. |
| 9,814,389 B2 | 11/2017 | DeHennis |
| 9,839,379 B2 | 12/2017 | Al-Ali et al. |
| 9,839,381 B1 | 12/2017 | Weber et al. |
| 9,847,749 B2 | 12/2017 | Kiani et al. |
| 9,848,800 B1 | 12/2017 | Lee et al. |
| 9,861,298 B2 | 1/2018 | Eckerbom et al. |
| 9,861,305 B1 | 1/2018 | Weber et al. |
| 9,867,540 B2 | 1/2018 | Tankiewicz et al. |
| 9,877,650 B2 | 1/2018 | Muhsin et al. |
| 9,891,079 B2 | 2/2018 | Dalvi |
| 9,924,897 B1 | 3/2018 | Abdul-Hafiz |
| 9,931,068 B2 | 4/2018 | Huffstetler et al. |
| 9,936,917 B2 | 4/2018 | Poeze et al. |
| 9,955,937 B2 | 5/2018 | Telfort |
| 9,965,946 B2 | 5/2018 | Al-Ali et al. |
| D820,865 S | 6/2018 | Muhsin et al. |
| 9,986,952 B2 | 6/2018 | Dalvi et al. |
| 9,993,555 B2 | 6/2018 | Akers et al. |
| D822,215 S | 7/2018 | Al-Ali et al. |
| D822,216 S | 7/2018 | Barker et al. |
| 10,010,276 B2 | 7/2018 | Al-Ali et al. |
| 10,086,138 B1 | 10/2018 | Novak, Jr. |
| 10,111,588 B2 | 10/2018 | Tankiewicz et al. |
| 10,111,591 B2 | 10/2018 | Dyell et al. |
| D833,624 S | 11/2018 | DeJong et al. |
| 10,119,911 B2 | 11/2018 | Huffstetler et al. |
| 10,123,729 B2 | 11/2018 | Dyell et al. |
| D835,282 S | 12/2018 | Barker et al. |
| D835,283 S | 12/2018 | Barker et al. |
| D835,284 S | 12/2018 | Barker et al. |
| D835,285 S | 12/2018 | Barker et al. |
| 10,149,616 B2 | 12/2018 | Al-Ali et al. |
| 10,154,815 B2 | 12/2018 | Al-Ali et al. |
| 10,159,412 B2 | 12/2018 | Lamego et al. |
| 10,188,348 B2 | 1/2019 | Al-Ali et al. |
| RE47,218 E | 2/2019 | Al-Ali |
| RE47,244 E | 2/2019 | Kiani et al. |
| RE47,249 E | 2/2019 | Kiani et al. |
| 10,205,291 B2 | 2/2019 | Scruggs et al. |
| 10,226,187 B2 | 3/2019 | Al-Ali et al. |
| 10,231,657 B2 | 3/2019 | Al-Ali et al. |
| 10,231,670 B2 | 3/2019 | Blank et al. |
| RE47,353 E | 4/2019 | Kiani et al. |
| 10,279,247 B2 | 5/2019 | Kiani |
| 10,292,664 B2 | 5/2019 | Al-Ali |
| 10,299,720 B2 | 5/2019 | Brown et al. |
| 10,327,337 B2 | 6/2019 | Schmidt et al. |
| 10,327,713 B2 | 6/2019 | Barker et al. |
| 10,332,630 B2 | 6/2019 | Al-Ali |
| 10,383,520 B2 | 8/2019 | Wojtczuk et al. |
| 10,383,527 B2 | 8/2019 | Al-Ali |
| 10,388,120 B2 | 8/2019 | Muhsin et al. |
| D864,120 S | 10/2019 | Forrest et al. |
| 10,441,181 B1 | 10/2019 | Telfort et al. |
| 10,441,196 B2 | 10/2019 | Eckerbom et al. |
| 10,448,844 B2 | 10/2019 | Al-Ali et al. |
| 10,448,871 B2 | 10/2019 | Al-Ali et al. |
| 10,456,038 B2 | 10/2019 | Lamego et al. |
| 10,463,340 B2 | 11/2019 | Telfort et al. |
| 10,471,159 B1 | 11/2019 | Lapotko et al. |
| 10,505,311 B2 | 12/2019 | Al-Ali et al. |
| 10,524,738 B2 | 1/2020 | Olsen |
| 10,532,174 B2 | 1/2020 | Al-Ali |
| 10,537,285 B2 | 1/2020 | Shreim et al. |
| 10,542,903 B2 | 1/2020 | Al-Ali et al. |
| 10,555,678 B2 | 2/2020 | Dalvi et al. |
| 10,568,553 B2 | 2/2020 | O'Neil et al. |
| RE47,882 E | 3/2020 | Al-Ali |
| 10,608,817 B2 | 3/2020 | Haider et al. |
| D880,477 S | 4/2020 | Forrest et al. |
| 10,617,302 B2 | 4/2020 | Al-Ali et al. |
| 10,617,335 B2 | 4/2020 | Al-Ali et al. |
| 10,637,181 B2 | 4/2020 | Al-Ali et al. |
| 10,662,333 B2 | 5/2020 | Colvin, Jr. |
| D886,849 S | 6/2020 | Muhsin et al. |
| D887,548 S | 6/2020 | Abdul-Hafiz et al. |
| D887,549 S | 6/2020 | Abdul-Hafiz et al. |
| 10,667,764 B2 | 6/2020 | Ahmed et al. |
| D890,708 S | 7/2020 | Forrest et al. |
| 10,721,785 B2 | 7/2020 | Al-Ali |
| 10,736,518 B2 | 8/2020 | Al-Ali et al. |
| 10,750,984 B2 | 8/2020 | Pauley et al. |
| D897,098 S | 9/2020 | Al-Ali |
| 10,779,098 B2 | 9/2020 | Iswanto et al. |
| 10,827,961 B1 | 11/2020 | Iyengar et al. |
| 10,828,007 B1 | 11/2020 | Telfort et al. |
| 10,832,818 B2 | 11/2020 | Muhsin et al. |
| 10,849,554 B2 | 12/2020 | Shreim et al. |
| 10,856,750 B2 | 12/2020 | Indorf |
| D906,970 S | 1/2021 | Forrest et al. |
| D908,213 S | 1/2021 | Abdul-Hafiz et al. |
| 10,918,281 B2 | 2/2021 | Al-Ali et al. |
| 10,932,705 B2 | 3/2021 | Muhsin et al. |
| 10,932,729 B2 | 3/2021 | Kiani et al. |
| 10,939,878 B2 | 3/2021 | Kiani et al. |
| 10,956,950 B2 | 3/2021 | Al-Ali et al. |
| D916,135 S | 4/2021 | Indorf et al. |
| D917,046 S | 4/2021 | Abdul-Hafiz et al. |
| D917,550 S | 4/2021 | Indorf et al. |
| D917,564 S | 4/2021 | Indorf et al. |
| D917,704 S | 4/2021 | Al-Ali et al. |
| 10,987,066 B2 | 4/2021 | Chandran et al. |
| 10,991,135 B2 | 4/2021 | Al-Ali et al. |
| D919,094 S | 5/2021 | Al-Ali et al. |
| D919,100 S | 5/2021 | Al-Ali et al. |
| 11,006,867 B2 | 5/2021 | Al-Ali |
| D921,202 S | 6/2021 | Al-Ali et al. |
| 11,024,064 B2 | 6/2021 | Muhsin et al. |
| 11,026,604 B2 | 6/2021 | Chen et al. |
| D925,597 S | 7/2021 | Chandran et al. |
| D927,699 S | 8/2021 | Al-Ali et al. |
| 11,076,777 B2 | 8/2021 | Lee et al. |
| 11,114,188 B2 | 9/2021 | Poeze et al. |
| D933,232 S | 10/2021 | Al-Ali et al. |
| D933,233 S | 10/2021 | Al-Ali et al. |
| D933,234 S | 10/2021 | Al-Ali et al. |
| 11,145,408 B2 | 10/2021 | Sampath et al. |

(56) References Cited

U.S. PATENT DOCUMENTS

| | | |
|---|---|---|
| 11,147,518 B1 | 10/2021 | Al-Ali et al. |
| 11,185,262 B2 | 11/2021 | Al-Ali et al. |
| 11,191,484 B2 | 12/2021 | Kiani et al. |
| D946,596 S | 3/2022 | Ahmed |
| D946,597 S | 3/2022 | Ahmed |
| D946,598 S | 3/2022 | Ahmed |
| D946,617 S | 3/2022 | Ahmed |
| 11,272,839 B2 | 3/2022 | Al-Ali et al. |
| 11,289,199 B2 | 3/2022 | Al-Ali |
| RE49,034 E | 4/2022 | Al-Ali |
| 11,298,021 B2 | 4/2022 | Muhsin et al. |
| D950,580 S | 5/2022 | Ahmed |
| D950,599 S | 5/2022 | Ahmed |
| D950,738 S | 5/2022 | Al-Ali et al. |
| D957,648 S | 7/2022 | Al-Ali |
| 11,382,567 B2 | 7/2022 | O'Brien et al. |
| 11,389,093 B2 | 7/2022 | Triman et al. |
| 11,406,286 B2 | 8/2022 | Al-Ali et al. |
| 11,417,426 B2 | 8/2022 | Muhsin et al. |
| 11,439,329 B2 | 9/2022 | Lamego |
| 11,445,948 B2 | 9/2022 | Scruggs et al. |
| D965,789 S | 10/2022 | Al-Ali et al. |
| D967,433 S | 10/2022 | Al-Ali et al. |
| 11,464,410 B2 | 10/2022 | Muhsin |
| 11,504,058 B1 | 11/2022 | Sharma et al. |
| 11,504,066 B1 | 11/2022 | Dalvi et al. |
| D971,933 S | 12/2022 | Ahmed |
| D973,072 S | 12/2022 | Ahmed |
| D973,685 S | 12/2022 | Ahmed |
| D973,686 S | 12/2022 | Ahmed |
| D974,193 S | 1/2023 | Forrest et al. |
| D979,516 S | 2/2023 | Al-Ali et al. |
| D980,091 S | 3/2023 | Forrest et al. |
| 11,596,363 B2 | 3/2023 | Lamego |
| 11,627,919 B2 | 4/2023 | Kiani et al. |
| 11,637,437 B2 | 4/2023 | Al-Ali et al. |
| D985,498 S | 5/2023 | Al-Ali et al. |
| 11,653,862 B2 | 5/2023 | Dalvi et al. |
| D989,112 S | 6/2023 | Muhsin et al. |
| D989,327 S | 6/2023 | Al-Ali et al. |
| 11,678,829 B2 | 6/2023 | Al-Ali et al. |
| 11,679,579 B2 | 6/2023 | Al-Ali |
| 11,684,296 B2 | 6/2023 | Vo et al. |
| 11,692,934 B2 | 7/2023 | Normand et al. |
| 11,701,043 B2 | 7/2023 | Al-Ali et al. |
| D997,365 S | 8/2023 | Hwang |
| 11,721,105 B2 | 8/2023 | Ranasinghe et al. |
| 11,730,379 B2 | 8/2023 | Ahmed et al. |
| D998,625 S | 9/2023 | Indorf et al. |
| D998,630 S | 9/2023 | Indorf et al. |
| D998,631 S | 9/2023 | Indorf et al. |
| 11,766,198 B2 | 9/2023 | Pauley et al. |
| D1,000,975 S | 10/2023 | Al-Ali et al. |
| 2001/0034477 A1 | 10/2001 | Mansfield et al. |
| 2001/0039483 A1 | 11/2001 | Brand et al. |
| 2002/0010401 A1 | 1/2002 | Bushmakin et al. |
| 2002/0058864 A1 | 5/2002 | Mansfield et al. |
| 2002/0133080 A1 | 9/2002 | Apruzzese et al. |
| 2003/0013975 A1 | 1/2003 | Kiani |
| 2003/0018243 A1 | 1/2003 | Gerhardt et al. |
| 2003/0144582 A1 | 7/2003 | Cohen et al. |
| 2003/0156288 A1 | 8/2003 | Barnum et al. |
| 2003/0212312 A1 | 11/2003 | Coffin, IV et al. |
| 2004/0106163 A1 | 6/2004 | Workman, Jr. et al. |
| 2005/0055276 A1 | 3/2005 | Kiani et al. |
| 2005/0118726 A1 | 6/2005 | Schultz et al. |
| 2005/0234317 A1 | 10/2005 | Kiani |
| 2006/0073719 A1 | 4/2006 | Kiani |
| 2006/0189871 A1 | 8/2006 | Al-Ali et al. |
| 2007/0073116 A1 | 3/2007 | Kiani et al. |
| 2007/0136825 A1 | 6/2007 | Frommer et al. |
| 2007/0180140 A1 | 8/2007 | Welch et al. |
| 2007/0244377 A1 | 10/2007 | Cozad et al. |
| 2008/0064965 A1 | 3/2008 | Jay et al. |
| 2008/0094228 A1 | 4/2008 | Welch et al. |
| 2008/0103375 A1 | 5/2008 | Kiani |
| 2008/0221418 A1 | 9/2008 | Al-Ali et al. |
| 2009/0036759 A1 | 2/2009 | Ault et al. |
| 2009/0093687 A1 | 4/2009 | Telfort et al. |
| 2009/0095926 A1 | 4/2009 | MacNeish, III |
| 2009/0221442 A1 | 9/2009 | Dower et al. |
| 2009/0247984 A1 | 10/2009 | Lamego et al. |
| 2009/0275844 A1 | 11/2009 | Al-Ali |
| 2010/0004518 A1 | 1/2010 | Vo et al. |
| 2010/0030040 A1 | 2/2010 | Poeze et al. |
| 2010/0099964 A1 | 4/2010 | O'Reilly et al. |
| 2010/0234718 A1 | 9/2010 | Sampath et al. |
| 2010/0270257 A1 | 10/2010 | Wachman et al. |
| 2011/0028806 A1 | 2/2011 | Merritt et al. |
| 2011/0028809 A1 | 2/2011 | Goodman |
| 2011/0040197 A1 | 2/2011 | Welch et al. |
| 2011/0082711 A1 | 4/2011 | Poeze et al. |
| 2011/0087081 A1 | 4/2011 | Kiani et al. |
| 2011/0118561 A1 | 5/2011 | Tari et al. |
| 2011/0137297 A1 | 6/2011 | Kiani et al. |
| 2011/0172498 A1 | 7/2011 | Olsen et al. |
| 2011/0230733 A1 | 9/2011 | Al-Ali |
| 2012/0123231 A1 | 5/2012 | O'Reilly |
| 2012/0165629 A1 | 6/2012 | Merritt et al. |
| 2012/0209084 A1 | 8/2012 | Olsen et al. |
| 2012/0226117 A1 | 9/2012 | Lamego et al. |
| 2012/0283524 A1 | 11/2012 | Kiani et al. |
| 2013/0023775 A1 | 1/2013 | Lamego et al. |
| 2013/0041591 A1 | 2/2013 | Lamego |
| 2013/0060147 A1 | 3/2013 | Welch et al. |
| 2013/0096405 A1 | 4/2013 | Garfio |
| 2013/0211213 A1 | 8/2013 | DeHennis et al. |
| 2013/0296672 A1 | 11/2013 | O'Neil et al. |
| 2013/0345921 A1 | 12/2013 | Al-Ali et al. |
| 2014/0088383 A1 | 3/2014 | Colvin, Jr. et al. |
| 2014/0166076 A1 | 6/2014 | Kiani et al. |
| 2014/0180160 A1 | 6/2014 | Brown et al. |
| 2014/0187973 A1 | 7/2014 | Brown et al. |
| 2014/0275871 A1 | 9/2014 | Lamego et al. |
| 2014/0275872 A1 | 9/2014 | Merritt et al. |
| 2014/0316217 A1 | 10/2014 | Purdon et al. |
| 2014/0316218 A1 | 10/2014 | Purdon et al. |
| 2014/0323897 A1 | 10/2014 | Brown et al. |
| 2014/0323898 A1 | 10/2014 | Purdon et al. |
| 2014/0343381 A1 | 11/2014 | Whitehurst et al. |
| 2015/0005600 A1 | 1/2015 | Blank et al. |
| 2015/0011907 A1 | 1/2015 | Purdon et al. |
| 2015/0073241 A1 | 3/2015 | Lamego |
| 2015/0080754 A1 | 3/2015 | Purdon et al. |
| 2015/0099950 A1 | 4/2015 | Al-Ali et al. |
| 2015/0182115 A1 | 7/2015 | DeHennis |
| 2016/0196388 A1 | 7/2016 | Lamego |
| 2016/0367173 A1 | 12/2016 | Dalvi et al. |
| 2017/0024748 A1 | 1/2017 | Haider |
| 2017/0042488 A1 | 2/2017 | Muhsin |
| 2017/0173632 A1 | 6/2017 | Al-Ali |
| 2017/0251974 A1 | 9/2017 | Shreim et al. |
| 2017/0311891 A1 | 11/2017 | Kiani et al. |
| 2018/0103874 A1 | 4/2018 | Lee et al. |
| 2018/0242926 A1 | 8/2018 | Muhsin et al. |
| 2018/0247353 A1 | 8/2018 | Al-Ali et al. |
| 2018/0247712 A1 | 8/2018 | Muhsin et al. |
| 2018/0256087 A1 | 9/2018 | Al-Ali et al. |
| 2018/0300919 A1 | 10/2018 | Muhsin et al. |
| 2018/0310822 A1 | 11/2018 | Indorf et al. |
| 2018/0310823 A1 | 11/2018 | Al-Ali et al. |
| 2018/0317826 A1 | 11/2018 | Muhsin et al. |
| 2019/0015023 A1 | 1/2019 | Monfre |
| 2019/0117070 A1 | 4/2019 | Muhsin et al. |
| 2019/0200941 A1 | 7/2019 | Chandran et al. |
| 2019/0239787 A1 | 8/2019 | Pauley et al. |
| 2019/0320906 A1 | 10/2019 | Olsen |
| 2019/0374139 A1 | 12/2019 | Kiani et al. |
| 2019/0374173 A1 | 12/2019 | Kiani et al. |
| 2019/0374713 A1 | 12/2019 | Kiani et al. |
| 2020/0060869 A1 | 2/2020 | Telfort et al. |
| 2020/0111552 A1 | 4/2020 | Ahmed |
| 2020/0113435 A1 | 4/2020 | Muhsin |
| 2020/0113488 A1 | 4/2020 | Al-Ali et al. |

(56) References Cited

U.S. PATENT DOCUMENTS

| | | |
|---|---|---|
| 2020/0113496 A1 | 4/2020 | Scruggs et al. |
| 2020/0113497 A1 | 4/2020 | Triman et al. |
| 2020/0113520 A1 | 4/2020 | Abdul-Hafiz et al. |
| 2020/0138288 A1 | 5/2020 | Al-Ali et al. |
| 2020/0138368 A1 | 5/2020 | Kiani et al. |
| 2020/0163597 A1 | 5/2020 | Dalvi et al. |
| 2020/0196877 A1 | 6/2020 | Vo et al. |
| 2020/0253474 A1 | 8/2020 | Muhsin et al. |
| 2020/0253544 A1 | 8/2020 | Belur Nagaraj et al. |
| 2020/0275841 A1 | 9/2020 | Telfort et al. |
| 2020/0288983 A1 | 9/2020 | Telfort et al. |
| 2020/0321793 A1 | 10/2020 | Al-Ali et al. |
| 2020/0329983 A1 | 10/2020 | Al-Ali et al. |
| 2020/0329984 A1 | 10/2020 | Al-Ali et al. |
| 2020/0329993 A1 | 10/2020 | Al-Ali et al. |
| 2020/0330037 A1 | 10/2020 | Al-Ali et al. |
| 2021/0022628 A1 | 1/2021 | Telfort et al. |
| 2021/0104173 A1 | 4/2021 | Pauley et al. |
| 2021/0113121 A1 | 4/2021 | Diab et al. |
| 2021/0117525 A1 | 4/2021 | Kiani et al. |
| 2021/0118581 A1 | 4/2021 | Kiani et al. |
| 2021/0161465 A1 | 6/2021 | Barker et al. |
| 2021/0236729 A1 | 8/2021 | Kiani et al. |
| 2021/0256835 A1 | 8/2021 | Ranasinghe et al. |
| 2021/0275101 A1 | 9/2021 | Vo et al. |
| 2021/0290072 A1 | 9/2021 | Forrest |
| 2021/0290080 A1 | 9/2021 | Ahmed |
| 2021/0290120 A1 | 9/2021 | Al-Ali |
| 2021/0290177 A1 | 9/2021 | Novak, Jr. |
| 2021/0290184 A1 | 9/2021 | Ahmed |
| 2021/0296008 A1 | 9/2021 | Novak, Jr. |
| 2021/0330228 A1 | 10/2021 | Olsen et al. |
| 2021/0386382 A1 | 12/2021 | Olsen et al. |
| 2021/0402110 A1 | 12/2021 | Pauley et al. |
| 2022/0039707 A1 | 2/2022 | Sharma et al. |
| 2022/0053892 A1 | 2/2022 | Al-Ali et al. |
| 2022/0071562 A1 | 3/2022 | Kiani |
| 2022/0096603 A1 | 3/2022 | Kiani et al. |
| 2022/0151521 A1 | 5/2022 | Krishnamani et al. |
| 2022/0218244 A1 | 7/2022 | Kiani et al. |
| 2022/0287574 A1 | 9/2022 | Telfort et al. |
| 2022/0296161 A1 | 9/2022 | Al-Ali et al. |
| 2022/0361819 A1 | 11/2022 | Al-Ali et al. |
| 2022/0379059 A1 | 12/2022 | Yu et al. |
| 2022/0392610 A1 | 12/2022 | Kiani et al. |
| 2023/0028745 A1 | 1/2023 | Al-Ali |
| 2023/0038389 A1 | 2/2023 | Vo |
| 2023/0045647 A1 | 2/2023 | Vo |
| 2023/0058052 A1 | 2/2023 | Ai-Ali |
| 2023/0058342 A1 | 2/2023 | Kiani |
| 2023/0069789 A1 | 3/2023 | Koo et al. |
| 2023/0087671 A1 | 3/2023 | Telfort et al. |
| 2023/0110152 A1 | 4/2023 | Forrest et al. |
| 2023/0111198 A1 | 4/2023 | Yu et al. |
| 2023/0115397 A1 | 4/2023 | Vo et al. |
| 2023/0116371 A1 | 4/2023 | Mills et al. |
| 2023/0135297 A1 | 5/2023 | Kiani et al. |
| 2023/0138098 A1 | 5/2023 | Telfort et al. |
| 2023/0145155 A1 | 5/2023 | Krishnamani et al. |
| 2023/0147750 A1 | 5/2023 | Barker et al. |
| 2023/0210417 A1 | 7/2023 | Al-Ali et al. |
| 2023/0222805 A1 | 7/2023 | Muhsin et al. |
| 2023/0222887 A1 | 7/2023 | Muhsin et al. |
| 2023/0226331 A1 | 7/2023 | Kiani et al. |
| 2023/0284916 A1 | 9/2023 | Telfort |
| 2023/0284943 A1 | 9/2023 | Scruggs et al. |
| 2023/0301562 A1 | 9/2023 | Scruggs et al. |

FOREIGN PATENT DOCUMENTS

| | | |
|---|---|---|
| EP | 2 705 850 | 4/2016 |
| WO | WO 96/036275 | 11/1996 |
| WO | WO 03/025220 | 3/2003 |
| WO | WO 2016/059635 | 4/2016 |
| WO | WO 2021/081404 | 4/2021 |

OTHER PUBLICATIONS

Deuschle et al., "Construction and Optimization of a Family of Genetically Encoded Metabolite Sensors by Semirational Protein Engineering", Protein Science, 2005, vol. 14, pp. 2304-2314.

Fehr et al., "In Vivo Imaging of the Dynamics of Flucose Uptake in the Cytosol of COS-7 Cells by Fluorescent Nanosensors", The Journal of Biological Chemistry, vol. 278, No. 21, May 23, 2003, pp. 12127-19133.

Humalog-Insulin Lispro Injection Solution Prescribing Information, Nov. 2019 (in 62 pages).

International Search Report and Written Opinion received in PCT Application No. PCT/US2020/057164, dated Feb. 24, 2021 in 16 pages.

Köker et al., "Characterization of Split Fluorescent Protein Variants and Quantitative Analyses of Their Self-Assembly Process", Scientific Reports, Mar. 2018, vol. 8, No. 5344, pp. 1-15.

Lindenburg et al., "Engineering Genetically Encoded FRET Sensors", Sensors, 2014, vol. 14, pp. 11691-11713.

Otten et al., "A FRET-Based Biosensor for the Quantification of Glucose in Culture Supernatants of mL Scale Microbial Cultivations", Microbial Cell Factories, 2019, vol. 18, No. 143, pp. 1-10.

Vajo et al., "Recombinant DNA Technology in the Treatment of Diabetes: Insulin Analogs", Endocrine Reviews, Oct. 2001, vol. 22, No. 5, pp. 706-717.

Valdastri et al., "Wireless Implantable Electronic Platform for Chronic Fluorescent-Based Biosensors", IEEE Transactions on Biomedical Engineering, vol. 58, No. 6, Jun. 2011, pp. 1846-1854.

White et al., "Biosimilar and Follow-on Insulin: The Ins, Outs, and Interchangeability", Journal of Pharmacy Technology, 2019, vol. 35, No. 1, pp. 25-35.

Ye et al., "Genetic Engineering of an Allosterically Based Glucose Indicator Protein for Continuous Glucose Monitoring by Fluorescence Resonance Energy Transfer", Analytical Chemistry, Jul. 15, 2003, vol. 75, pp. 3451-3459.

Day, R. et al., "The fluorescent protein palette: tools for cellular imaging." Chem Soc Rev. Oct. 2009; 38(10): 2887-2921.

Hu, H.et al., "Glucose monitoring in living cells with single fluorescent protein-based sensors." RSC Adv., 2018, 8 (5), 2485-2489.

Mita, M. et.al., "Green Fluorescent Protein-Based Glucose Indicators Report Glucose Dynamics in Living Cells." Anal.Chem., 2019, (91) 4821-4830.

Yue, J. et al., "Development of an Intrinsic Skin Sensor for Blood Glucose Level with CRISPR-mediated Genome Editing in Epidermal Stem Cells," Sep. 28, 2017, pp. 30.

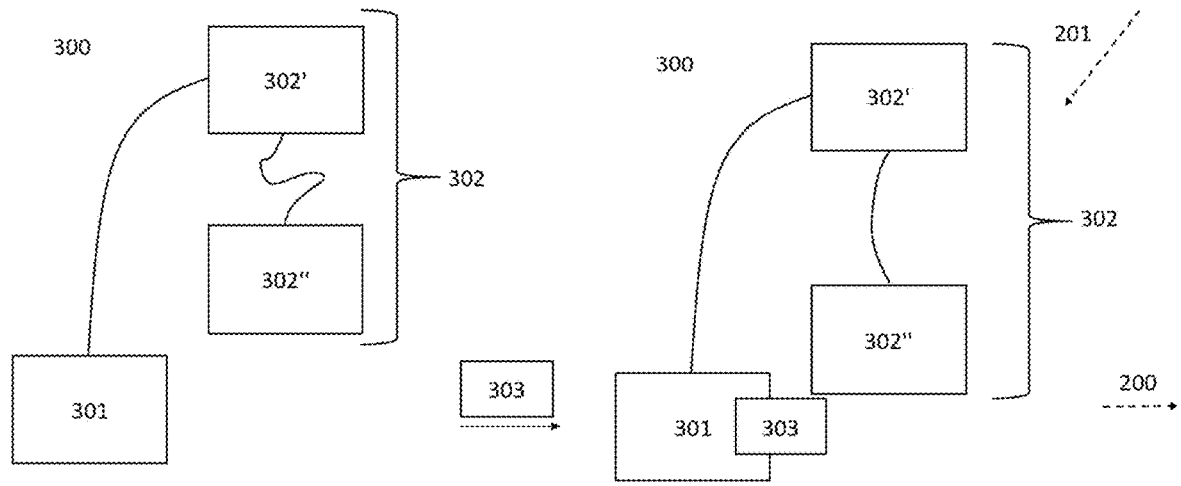

FIG. 1C

```
SEQ ID NO: 1
Citrine Amino Acid Sequence
VSKGEELFTG VVPILVELDG DVNGHKFSVS GEGEGDATYG KLTLKFICTT GKLPVPWPTL VTTFGYGLMC
FARYPDHMKQ HDFFKSAMPE GYVQERTIFF KDDGNYKTRA EVKFEGDTLV NRIELKGIDF KEDGNILGHK
LEYNYNSHNV YIMADKQKNG IKVNFKIRHN IEDGSVQLAD HYQQNTPIGD GPVLLPDNHY LSYQSALSKD
PNEKRDHMVL LEFVTAAGIT LGMDELYK
```

FIG. 2A

```
SEQ ID NO: 2
MglB Amino Acid Sequence
MNKKVLTLSA VMASMLFGAA AHAADTRIGV TIYKYDDNFM SVVRKAIEQD AKAAPDVQLL MNDSQNDQSK
QNDQIDVLLA KGVKALAINL VDPAAAGTVI EKARGQNVPV VFFNKEPSRK ALDSYDKAYY VGTDSKESGI
IQGDLIAKHW AANQGWDLNK DGQIQFVLLK GEPGHPDAEA RTTYVIKELN DKGIKTEQLQ LDTAMWDTAQ
AKDKMDAWLS GPNANKIEVV IANNDAMAMG AVEALKAHNK SSIPVFGVDA LPEALALVKS GALAGTVLND
ANNQAKATFD LAKNLADGKG AADGTNWKID NKVVRVPYVG VDKDNLAEFS KK
```

FIG. 2B

```
SEQ ID NO: 3
>Glifon5 v1  (1746 bp)
MRFGLWRYPL MATPGCWQNP RSPCSVVNST CTVSKGEELF TGVVPILVEL DGDVNGHKFS VSGEGEGDAT
YGKLTLKFIC TTGKLPVPWP TLVTTFGYGL MCFARYPDHM KQHDFFKSAM PEGYVQERTI FFKDDGNYKT
RAEVKFEGDT LVNRIELKGI DFKEDGNILG HKLEFGLLGV DTSIGVTIYK YDDNFMSVVR KAIEQDAKAA
PDVQLLMNDS QNDQSKQNDQ IDVLLAKGVK ALAINLVDPA AAGTVIEKAR GQNVPVVFFN KEPSRKALDS
YDKAYYVGTD SKESGIIQGD LIAKHWAANQ GWDLNKDGQI QFVLLKGEPG HPDAEARTTY VIKELNDKGI
KTEQLQLDTA MWDTAQAKDK MDAWLSGPNA NKIEVVIANN DAMAMGAVEA LKAHNKSSIP VFGVDALPEA
LALVKSGALA GIVLNDANNQ AKATFDLAKN LADGKGAADG TNWKIDNKVV RVPYVGVDKD NLAEFSEVDS
HNVYIMADKQ KNGIKVNFKI RHNIEDGSVQ LADHYQQNTP IGDGPVLLPD NHYLSYQSAL SKDPNEKRDH
MVLLEFVTAA GITLGMDELY K*
```

FIG. 2C(1)

SEQ ID NO: 4
>Glifon50 v1  (1746 bp)
MRFGLWRYPL MATPGCWQNP RSPCSVVNST CTVSKGEELF TGVVPILVEL DGDVNGHKFS VSGEGEGDAT
YGKLTLKFIC TTGKLPVPWP TLVTTFGYGL MCFARYPDHM KQHDFFKSAM PEGYVQERTI FFKDDGNYKT
RAEVKFEGDT LVNRIELKGI DFKEDGNILG HKLEFGLLGV DTSIGVTIYK YDDNYMSVVR KAIEQDAKAA
PDVQLLMNDS QNDQSKQNDQ IDVLLAKGVK ALAINLVDPA AAGTVIEKAR GQNVPVVFFN KEPSRKALDS
YDKAYYVGTD SKESGIIQGD LIAKHWAANQ GWDLNKDGQI QFVLLKGEPG HPDAEARTTY VIKELNDKGI
KTEQLQLDTA MWDTAQAKDK MDAWLSGPNA NKIEVVIANN DAMAMGAVEA LKAHNKSSIP VFGVDALPEA
LALVKSGALA GTVLNDANNQ AKATFDLAKN LADGKGAADG TNWKIDNKVV RVPYVGVDKD NLAEFSEVDS
HNVYIMADKQ KNGIKVNFKI RHNIEDGSVQ LADHYQQNTP IGDGPVLLPD NHYLSYQSAL SKDPNEKRDH
MVLLEFVTAA GITLGMDELY K*

FIG. 2C(2)

SEQ ID NO: 5
>Glifon600 v1  (1746 bp)
MRFGLWRYPL MATPGCWQNP RSPCSVVNST CTVSKGEELF TGVVPILVEL DGDVNGHKFS VSGEGEGDAT
YGKLTLKFIC TTGKLPVPWP TLVTTFGYGL MCFARYPDHM KQHDFFKSAM PEGYVQERTI FFKDDGNYKT
RAEVKFEGDT LVNRIELKGI DFKEDGNILG HKLEFGLLGV DTSIGVTIYK YDDYYMSVVR KAIEQDAKAA
PDVQLLMNDS QNDQSKQNDQ IDVLLAKGVK ALAINLVDPA AAGTVIEKAR GQNVPVVFFN KEPSRKALDS
YDKAYYVGTD SKESGIIQGD LIAKHWAANQ GWDLNKDGQI QFVLLKGEPG HPDAEARTTY VIKELNDKGI
KTEQLQLDTA MWDTAQAKDK MDAWLSGPNA NKIEVVIANN DAMAMGAVEA LKAHNKSSIP VFGVDALPEA
LALVKSGALA GTVLNDANNQ AKATFDLAKN LADGKGAADG TNWKIDNKVV RVPYVGVDKD NLAEFSEVDS
HNVYIMADKQ KNGIKVNFKI RHNIEDGSVQ LADHYQQNTP IGDGPVLLPD NHYLSYQSAL SKDPNEKRDH
MVLLEFVTAA GITLGMDELY K*

FIG. 2C(3)

SEQ ID NO: 6
>Glifon4000 v1  (1746 bp)
MRFGLWRYPL MATPGCWQNP RSPCSVVNST CTVSKGEELF TGVVPILVEL DGDVNGHKFS VSGEGEGDAT
YGKLTLKFIC TTGKLPVPWP TLVTTFGYGL MCFARYPDHM KQHDFFKSAM PEGYVQERTI FFKDDGNYKT
RAEVKFEGDT LVNRIELKGI DFKEDGNILG HKLEFGLLGV DTSIGVTIYK YDDNLMSVVR KAIEQDAKAA
PDVQLLMNDS QNDQSKQNDQ IDVLLAKGVK ALAINLVDPA AAGTVIEKAR GQNVPVVFFN KEPSRKALDS
YDKAYYVGTD SKESGIIQGD LIAKHWAANQ GWDLNKDGQI QFVLLKGEPG HPDAEARTTY VIKELNDKGI
KTEQLQLDTA MWDTAQAKDK MDAWLSGPNA NKIEVVIANN DAMAMGAVEA LKAHNKSSIP VFGVDALPEA
LALVKSGALA GTVLNDANNQ AKATFDLAKN LADGKGAADG TNWKIDNKVV RVPYVGVDKD NLAEFSEVDS
HNVYIMADKQ KNGIKVNFKI RHNIEDGSVQ LADHYQQNTP IGDGPVLLPD NHYLSYQSAL SKDPNEKRDH
MVLLEFVTAA GITLGMDELY K*

FIG. 2C(4)

SEQ ID NO: 7
> Glifon50 v2
VSKGEELFTG VVPILVELDG DVNGHKFSVS GEGEGDATYG KLTLKFICTT GKLPVPWPTL VTTFGYGLMC
FARYPDHMKQ HDFFKSAMPE GYVQERTIFF KDDGNYKTRA EVKFEGDTLV NRIELKGIDF KEDGNILGHK
LEYNADTRIG VTIYKYDDNY MSVVRKAIEQ DAKAAPDVQL LMNDSQNDQS KQNDQIDVLL AKGVKALAIN
LVDPAAAGTV IEKARGQNVP VVFFNKEPSR KALDSYDKAY YVGTDSKESG IIQGDLIAKH WAANQGWDLN
KDGQIQFVLL KGEPGHPDAE ARTTYVIKEL NDKGIKTEQL QLDTAMWDTA QAKDKMDAWL SGPNANKIEV
VIANNDAMAM GAVEALKAHN KSSIPVFGVD ALPEALALVK SGALAGTVLN DANNQAKATF DLAKNLADGK
GAADGTNWKI DNKVVRVPYV GVDKDNLAEF SNSHNVYIMA DKQKNGIKVN FKIRHNIEDG SVQLADHYQQ
NTPIGDGPVL LPDNHYLSYQ SALSKDPNEK RDHMVLLEFV TAAGITLGMD ELYK

FIG. 2C(5)

SEQ ID NO: 8
> Glifon600 v2
VSKGEELFTG VVPILVELDG DVNGHKFSVS GEGEGDATYG KLTLKFICTT GKLPVPWPTL VTTFGYGLMC
FARYPDHMKQ HDFFKSAMPE GYVQERTIFF KDDGNYKTRA EVKFEGDTLV NRIELKGIDF KEDGNILGHK
LEYNADTRIG VTIYKYDDYY MSVVRKAIEQ DAKAAPDVQL LMNDSQNDQS KQNDQIDVLL AKGVKALAIN
LVDPAAAGTV IEKARGQNVP VVFFNKEPSR KALDSYDKAY YVGTDSKESG IIQGDLIAKH WAANQGWDLN
KDGQIQFVLL KGEPGHPDAE ARTTYVIKEL NDKGIKTEQL QLDTAMWDTA QAKDKMDAWL SGPNANKIEV
VIANNDAMAM GAVEALKAHN KSSIPVFGVD ALPEALALVK SGALAGTVLN DANNQAKATF DLAKNLADGK
GAADGTNWKI DNKVVRVPYV GVDKDNLAEF SNSHNVYIMA DKQKNGIKVN FKIRHNIEDG SVQLADHYQQ
NTPIGDGPVL LPDNHYLSYQ SALSKDPNEK RDHMVLLEFV TAAGITLGMD ELYK

FIG. 2C(6)

SEQ ID NO: 9
> Glifon4000 v2
VSKGEELFTG VVPILVELDG DVNGHKFSVS GEGEGDATYG KLTLKFICTT GKLPVPWPTL VTTFGYGLMC
FARYPDHMKQ HDFFKSAMPE GYVQERTIFF KDDGNYKTRA EVKFEGDTLV NRIELKGIDF KEDGNILGHK
LEYNADTRIG VTIYKYDDNL MSVVRKAIEQ DAKAAPDVQL LMNDSQNDQS KQNDQIDVLL AKGVKALAIN
LVDPAAAGTV IEKARGQNVP VVFFNKEPSR KALDSYDKAY YVGTDSKESG IIQGDLIAKH WAANQGWDLN
KDGQIQFVLL KGEPGHPDAE ARTTYVIKEL NDKGIKTEQL QLDTAMWDTA QAKDKMDAWL SGPNANKIEV
VIANNDAMAM GAVEALKAHN KSSIPVFGVD ALPEALALVK SGALAGTVLN DANNQAKATF DLAKNLADGK
GAADGTNWKI DNKVVRVPYV GVDKDNLAEF SNSHNVYIMA DKQKNGIKVN FKIRHNIEDG SVQLADHYQQ
NTPIGDGPVL LPDNHYLSYQ SALSKDPNEK RDHMVLLEFV TAAGITLGMD ELYK

FIG. 2C(7)

SEQ ID NO: 10
> Glifon5 v3
MVSKGEELFT GVVPILVELD GDVNGHKFSV SGEGEGDATY GKLTLKFICT TGKLPVPWPT LVTTFGYGLM
CFARYPDHMK QHDFFKSAMP EGYVQERTIF FKDDGNYKTR AEVKFEGDTL VNRIELKGID FKEDGNILGH
KLEFGLLGVD TSIGVTIYKY DDNFMSVVRK AIEQDAKAAP DVQLLMNDSQ NDQSKQNDQI DVLLAKGVKA
LAINLVDPAA AGTVIEKARG QNVPVVFFNK EPSRKALDSY DKAYYVGTDS KESGIIQGDL IAKHWAANQG
WDLNKDGQIQ FVLLKGEPGH PDAEARTTYV IKELNDKGIK TEQLQLDTAM WDTAQAKDKM DAWLSGPNAN
KIEVVIANND AMAMGAVEAL KAHNKSSIPV FGVDALPEAL ALVKSGALAG TVLNDANNQA KATFDLAKNL
ADGKGAADGT NWKIDNKVVR VPYVGVDKDN LAEFSEVDSH NVYIMADKQK NGIKVNFKIR HNIEDGSVQL
ADHYQQNTPI GDGPVLLPDN HYLSYQSALS KDPNEKRDHM VLLEFVTAAG ITLGMDELYK

FIG. 2C(8)

SEQ ID NO: 11
> Glifon50 v3
MVSKGEELFT GVVPILVELD GDVNGHKFSV SGEGEGDATY GKLTLKFICT TGKLPVPWPT LVTTFGYGLM
CFARYPDHMK QHDFFKSAMP EGYVQERTIF FKDDGNYKTR AEVKFEGDTL VNRIELKGID FKEDGNILGH
KLEFGLLGVD TSIGVTIYKY DDNYMSVVRK AIEQDAKAAP DVQLLMNDSQ NDQSKQNDQI DVLLAKGVKA
LAINLVDPAA AGTVIEKARG QNVPVVFFNK EPSRKALDSY DKAYYVGTDS KESGIIQGDL IAKHWAANQG
WDLNKDGQIQ FVLLKGEPGH PDAEARTTYV IKELNDKGIK TEQLQLDTAM WDTAQAKDKM DAWLSGPNAN
KIEVVIANND AMAMGAVEAL KAHNKSSIPV FGVDALPEAL ALVKSGALAG TVLNDANNQA KATFDLAKNL
ADGKGAADGT NWKIDNKVVR VPYVGVDKDN LAEFSEVDSH NVYIMADKQK NGIKVNFKIR HNIEDGSVQL
ADHYQQNTPI GDGPVLLPDN HYLSYQSALS KDPNEKRDHM VLLEFVTAAG ITLGMDELYK

FIG. 2C(9)

SEQ ID NO: 12
> Glifon600 v3
MVSKGEELFT GVVPILVELD GDVNGHKFSV SGEGEGDATY GKLTLKFICT TGKLPVPWPT LVTTFGYGLM
CFARYPDHMK QHDFFKSAMP EGYVQERTIF FKDDGNYKTR AEVKFEGDTL VNRIELKGID FKEDGNILGH
KLEFGLLGVD TSIGVTIYKY DDYYMSVVRK AIEQDAKAAP DVQLLMNDSQ NDQSKQNDQI DVLLAKGVKA
LAINLVDPAA AGTVIEKARG QNVPVVFFNK EPSRKALDSY DKAYYVGTDS KESGIIQGDL IAKHWAANQG
WDLNKDGQIQ FVLLKGEPGH PDAEARTTYV IKELNDKGIK TEQLQLDTAM WDTAQAKDKM DAWLSGPNAN
KIEVVIANND AMAMGAVEAL KAHNKSSIPV FGVDALPEAL ALVKSGALAG TVLNDANNQA KATFDLAKNL
ADGKGAADGT NWKIDNKVVR VPYVGVDKDN LAEFSEVDSH NVYIMADKQK NGIKVNFKIR HNIEDGSVQL
ADHYQQNTPI GDGPVLLPDN HYLSYQSALS KDPNEKRDHM VLLEFVTAAG ITLGMDELYK

FIG. 2C(10)

SEQ ID NO: 13
> Glifon4000 v3
MVSKGEELFT GVVPILVELD GDVNGHKFSV SGEGEGDATY GKLTLKFICT TGKLPVPWPT LVTTFGYGLM
CFARYPDHMK QHDFFKSAMP EGYVQERTIF FKDDGNYKTR AEVKFEGDTL VNRIELKGID FKEDGNILGH
KLEFGLLGVD TSIGVTIYKY DDNLMSVVRK AIEQDAKAAP DVQLLMNDSQ NDQSKQNDQI DVLLAKGVKA
LAINLVDPAA AGTVIEKARG QNVPVVFFNK EPSRKALDSY DKAYYVGTDS KESGIIQGDL IAKHWAANQG
WDLNKDGQIQ FVLLKGEPGH PDAEARTTYV IKELNDKGIK TEQLQLDTAM WDTAQAKDKM DAWLSGPNAN
KIEVVIANND AMAMGAVEAL KAHNKSSIPV FGVDALPEAL ALVKSGALAG TVLNDANNQA KATFDLAKNL
ADGKGAADGT NWKIDNKVVR VPYVGVDKDN LAEFSEVDSH NVYIMADKQK NGIKVNFKIR HNIEDGSVQL
ADHYQQNTPI GDGPVLLPDN HYLSYQSALS KDPNEKRDHM VLLEFVTAAG ITLGMDELYK

FIG. 2C(11)

SEQ ID NO: 14
cpYFP Amino Acid Sequence
YNSDNVYIMA DKQKNGIKAY FKIRHNVEDG SVQLADHYQQ NTPIGDGPVL LPDNHYLSFQ SVLSKDPNEK
RDHMVLLEFV TAAGITLGMD ELYNVDGGSG GTGSKGEELF TGVVPILVEL DGDVNGHKFS VSGEGEGDAT
YGKLTLKLIC TTGKLPVPWP TLVTTLGYGL KCFARYPDHM KQHDFFKSAM PEGYVQERTI FFKDDGNYKT
RAEVKFEGDT LVNRIELKGI GFKEDGNILG HKLEYN

FIG. 3A

SEQ ID NO: 15
Glucose Binding Protein Amino Acid Sequence
MADTRIGVTI YKDDNFMSV VRKAIEQDAK AAPDVQLLMN DSQNDQSKQN DQIDVLLAKG VKALAINLVD
PAAAGTVIEK ARGQNVPVVF FNKEPSRKAL DSYDKAYYVG TDSKESGIIQ GDLIAKHWAA NQGWDLNKDG
QIQFVLLKGE PGHPDAEART TYVIKELNDK GIKTEQLQLD TAMWDTAQAK DKMDAWLSGP NANKIEVVIA
NNDAMAMGAV EALKAHNKSS IPVFGVDALP EALVKSGA LAGTVLNDAN NQAKATFDLA KNLADGKGAA
DGTNWKIDNK VVRVPYVGVD KDNLAEFSKK

FIG. 3B

SEQ ID NO: 16
>FGBP_3.1µM (1671 bp)
MADTRIGVTI YKDDNFMSV VRKAIEQDAK AAPDVQLLMN DSQNDQSKQN DQIDVLLAKG VKALAINLVD
PAAAGTVIEK ARGQNVPVVF FNKEPSRKAL DSYDKAYYVG TDSKESGIIQ GDLIAKHWAA NQGWDLNKDG
QIQFVLLKGE PGHPDAEART TYVIKELNDK GIKTEQLQLD TAMWDTAQAK DKMDAWLSGP NANKIEVVIA
NNDAMAMGAV EALKAHNKSS IPVFGVDALP EALVKSGA LAGTVLNDAN NQAKATFDLA KNLADGKGAA
DGTNWKIDNK VVRVPYNSDN VYIMADKQKN GIKAYFKIRH NVEDGSVQLA DHYQQNTPIG DGPVLLPDNH
YLSFQSVLSK DPNEKRDHMV LLEFVTAAGI TLGMDELYNV DGGSGGTGSK GEELFTGVVP ILVELDGDVN
GHKFSVSGEG EGDATYGKLT LKLICTTGKL PVPWPTLVTT LGYGLKCFAR YPDHMKQHDF FKSAMPEGYV
QERTIFFKDD GNYKTRAEVK FEGDTLVNRI ELKGIGFKED GNILGHKLEY NYVGVDKDNL AEFSKK*

FIG. 3C(1)

SEQ ID NO: 17
>FGBP_27μM  (1650 bp)
```
MADTRIGVTI YKYDDNFMSV VRKAIEQDAK AAPDVQLLMN DSQNDQSKQN DQIDVLLAKG VKALAINLVD
PAAAGTVIEK ARGQNVPVVF FNKEPSRKAL DSYDKAYYVG TDSKESGIIQ GDLIAKHWAA NQGWDLNKDG
QIQFVLLKGE PGHPDAEART TYVIKELNDK GIKTEQLQLD TAMWDTAQAK DKMDAWLSGP NANKIEVVIA
NNDAMAMGAV EALKAHNKSS IPVFGVDALP EALALVKSGA LAGTVLNDAN NQAKATFDLA KNLADGKGAA
DGTNWKIDNK VVRVPDNVYI MADKQKNGIK AYFKIRHNVE DGSVQLADHY QQNTPIGDGP VLLPDNHYLS
FQSVLSKDPN EKRDHMVLLE FVTAAGITLG MDELYNVDGG SGGTGSKGEE LFTGVVPILV ELDGDVNGHK
FSVSGEGEGD ATYGKLTLKL ICTTGKLPVP WPTLVTTLGY GLKCFARYPD HMKQHDFFKS AMPEGYVQER
TIFFKDDGNY KTRAEVKFEG DTLVNRIELK GIGFKEDGNI LGHKYVGVDK DNLAEFSKK*
```

FIG. 3C(2)

SEQ ID NO: 18
>FGBP_380μM  (1650 bp)
```
MADTRIGVTI YKYDDNFMSV VRKAIEQDAK AAPDVQLLMN DSQNDQSKQN DQIDVLLAKG VKALAINLVD
PAAAGTVIEK ARGQNVPVVF FNKEPSRKAL DSYDKAYYVG TDSKESGIIQ GDLIAKHWAA NQGWDLNKDG
QIQFVLLKGE PGHPDAEART TYVIKELNDK GIKTEQLQLD TAMWDTAQAK DKMDAWLSGP NANKIEVVIA
NNDAMAMGAV EALKAHNKSS IPVFGVDALP EALALVKSGA LAGTVLSDAN NQAKATFDLA KNLADGKGAA
DGTNWKIDNK VVRVPDNVYI MADKQKNGIK AYFKIRHNVE DGSVQLADHY QQNTPIGDGP VLLPDNHYLS
FQSVLSKDPN EKRDHMVLLE FVTAAGITLG MDELYNVDGG SGGTGSKGEE LFTGVVPILV ELDGDVNGHK
FSVSGEGEGD ATYGKLTLKL ICTTGKLPVP WPTLVTTLGY GLKCFARYPD HMKQHDFFKS AMPEGYVQER
TIFFKDDGNY KTRAEVKFEG DTLVNRIELK GIGFKEDGNI LGHKYVGVDK DNLAEFSKK*
```

FIG. 3C(3)

SEQ ID NO: 19
>FGBP_1mM  (1650 bp)
```
MADTRIGVTI YKYDDNFMSV VRKAIEQDAK AAPDVQLLMN DSQNDQSKQN DQIDVLLAKG VKALAINLVD
PAAAGTVIEK ARGQNVPVVF FNKEPSRKAL DSYDKAYYVG TDSKESGIIQ GDLIAKHWAA NQGWDLNKDG
QIQFVLLKGE PGHPDAEART TYVIKELNDK GIKTEQLQLD TAMWDTAQAK DKMDAWLSGP NANKIEVVIA
NNDAMAMGAV EALKAHNKSS IPVFGVDASP EALALVKSGA LAGTVLNDAN NQAKATFDLA KNLADGKGAA
DGTNWKIDNK VVRVPDNVYI MADKQKNGIK AYFKIRHNVE DGSVQLADHY QQNTPIGDGP VLLPDNHYLS
FQSVLSKDPN EKRDHMVLLE FVTAAGITLG MDELYNVDGG SGGTGSKGEE LFTGVVPILV ELDGDVNGHK
FSVSGEGEGD ATYGKLTLKL ICTTGKLPVP WPTLVTTLGY GLKCFARYPD HMKQHDFFKS AMPEGYVQER
TIFFKDDGNY KTRAEVKFEG DTLVNRIELK GIGFKEDGNI LGHKYVGVDK DNLAEFSKK*
```

FIG. 3C(4)

SEQ ID NO: 20
>FGBP_3.2mM  (1650 bp)
```
MADTRIGVTI YKYDDNFMSV VRKAIEQDAK AAPDVQLLMN DSQNDQSKQN DQIDVLLAKG VKALAINLVD
PAAAGTVIEK ARGQNVPVVF FNKEPSRKAL DSYDKAYYVG TDSKESGIIQ GDLIAKHWAA NQGWDLNKDG
QIQFVLLKGE PGHPDAEART TYVIKELNDK GIKTEQLQLD TAMWDTAQAK DKMDAWLSGP NANKIEVVIA
NNDRMAMGAV EALKAHNKSS IPVFGVDALP EALALVKSGA LAGTVLNDAN NQAKATFDLA KNLADGKGAA
DGTNWKIDNK VVRVPDNVYI MADKQKNGIK AYFKIRHNVE DGSVQLADHY QQNTPIGDGP VLLPDNHYLS
FQSVLSKDPN EKRDHMVLLE FVTAAGITLG MDELYNVDGG SGGTGSKGEE LFTGVVPILV ELDGDVNGHK
FSVSGEGEGD ATYGKLTLKL ICTTGKLPVP WPTLVTTLGY GLKCFARYPD HMKQHDFFKS AMPEGYVQER
TIFFKDDGNY KTRAEVKFEG DTLVNRIELK GIGFKEDGNI LGHKYVGVDK DNLAEFSKK*
```

FIG. 3C(5)

```
SEQ ID NO: 21
>Glifon5 v1 (1746 bp)
ATGCGGTTCGGGCTCTGGAGGTACCCACTGATGGCAACGCCGGGCTGCTGGCAGAACCCCAGATCGCCATGTTCTGTGGT
AAACTCAACATGCACAGTGAGCAAGGGCGAGGAGCTGTTCACCGGGGTGGTGCCCATCCTGGTCGAGCTGGACGGCGACG
TAAACGGCCACAAGTTCAGCGTGTCCGGCGAGGGCGAGGGCGATGCCACCTACGGCAAGCTGACCCTGAAGTTCATCTGC
ACCACCGGCAAGCTGCCCGTGCCCTGGCCCACCCTCGTGACCACCTTCGGCTACGGCCTGATGTGCTTCGCCCGCTACCC
CGACCACATGAAGCAGCACGACTTCTTCAAGTCCGCCATGCCCGAAGGCTACGTCCAGGAGCGCACCATCTTCTTCAAGG
ACGACGGCAACTACAAGACCCGCGCCGAGGTGAAGTTCGAGGGCGACACCCTGGTGAACCGCATCGAGCTGAAGGGCATC
GACTTCAAGGAGGACGGCAACATCCTGGGGCACAAGCTGGAGTTCGGCCTTCTAGGCGTTGATACTAGCATTGGTGTAAC
AATCTATAAGTACGACGATAACTTTATGTCTGTAGTGCGCAAGGCTATTGAGCAAGATGCGAAAGCCGCGCCAGATGTTC
AGCTGCTGATGAATGATTCTCAGAATGACCAGTCCAAGCAGAACGATCAGATCGACGTATTGCTGGCCAAGGGGGTGAAG
GCACTGGCCATCAACCTGGTTGACCCGGCAGCTGCGGGTACGGTGATTGAGAAAGCGCGTGGGCAAAACGTGCCGGTGGT
TTTCTTCAACAAAGAACCGTCTCGTAAGGCGCTGGATAGCTACGACAAAGCCTACTACGTTGGCACTGACTCAAAAGAGT
CCGGCATTATTCAAGGCGATTTGATTGCTAAACACTGGGCGGCGAATCAGGGTTGGGATCTGAACAAAGACGGTCAGATT
CAGTTCGTACTGCTGAAAGGTGAACCGGGCCATCCGGATGCAGAAGCACGTACCACTTACGTGATTAAAGAATTGAACGA
TAAAGGCATCAAAACTGAACAGTTACAGTTAGATACCGCAATGTGGGACACCGCTCAGGCGAAAGATAAGATGGACGCCT
GGCTGTCTGGCCCGAACGCCAACAAAATCGAAGTGGTTATCGCCAACAACGATGCGATGGCAATGGGCGCGGTTGAAGCG
CTGAAAGCACACAACAAGTCCAGCATTCCGGTGTTTGGCGTCGATGCGCTGCCAGAAGCGCTGGCGCTGGTGAAATCCGG
TGCACTGGCGGGCACCGTACTGAACGATGCTAACAACCAGGCGAAAGCGACCTTTGATCTGGCGAAAAACCTGGCCGATG
GTAAAGGTGCGGCTGATGGCACCAACTGGAAAATCGACAACAAAGTGGTCCGCGTACCTTATGTTGGCGTAGATAAAGAC
AACCTGGCTGAATTCAGCGAAGTCGACAGCCACAACGTCTATATCATGGCCGACAAGCAGAAGAACGGCATCAAGGTGAA
CTTCAAGATCCGCCACAACATCGAGGACGGCAGCGTGCAGCTCGCCGACCACTACCAGCAGAACACCCCCATCGGCGACG
GCCCCGTGCTGCTGCCCGACAACCACTACCTGAGCTACCAGTCCGCCCTGAGCAAAGACCCCAACGAGAAGCGCGATCAC
ATGGTCCTGCTGGAGTTCGTGACCGCCGCCGGGATCACTCTCGGCATGGACGAGCTGTACAAGTAG
```

FIG. 4A(1)

```
SEQ ID NO: 22
>Glifon50 v1 (1746 bp)
ATGCGGTTCGGGCTCTGGAGGTACCCACTGATGGCAACGCCGGGCTGCTGGCAGAACCCCAGATCGCCATGTTCTGTGGT
AAACTCAACATGCACAGTGAGCAAGGGCGAGGAGCTGTTCACCGGGGTGGTGCCCATCCTGGTCGAGCTGGACGGCGACG
TAAACGGCCACAAGTTCAGCGTGTCCGGCGAGGGCGAGGGCGATGCCACCTACGGCAAGCTGACCCTGAAGTTCATCTGC
ACCACCGGCAAGCTGCCCGTGCCCTGGCCCACCCTCGTGACCACCTTCGGCTACGGCCTGATGTGCTTCGCCCGCTACCC
CGACCACATGAAGCAGCACGACTTCTTCAAGTCCGCCATGCCCGAAGGCTACGTCCAGGAGCGCACCATCTTCTTCAAGG
ACGACGGCAACTACAAGACCCGCGCCGAGGTGAAGTTCGAGGGCGACACCCTGGTGAACCGCATCGAGCTGAAGGGCATC
GACTTCAAGGAGGACGGCAACATCCTGGGGCACAAGCTGGAGTTCGGCCTTCTAGGCGTTGATACTAGCATTGGTGTAAC
AATCTATAAGTACGACGATAACTATATGTCTGTAGTGCGCAAGGCTATTGAGCAAGATGCGAAAGCCGCGCCAGATGTTC
AGCTGCTGATGAATGATTCTCAGAATGACCAGTCCAAGCAGAACGATCAGATCGACGTATTGCTGGCCAAGGGGGTGAAG
GCACTGGCCATCAACCTGGTTGACCCGGCAGCTGCGGGTACGGTGATTGAGAAAGCGCGTGGGCAAAACGTGCCGGTGGT
TTTCTTCAACAAAGAACCGTCTCGTAAGGCGCTGGATAGCTACGACAAAGCCTACTACGTTGGCACTGACTCAAAAGAGT
CCGGCATTATTCAAGGCGATTTGATTGCTAAACACTGGGCGGCGAATCAGGGTTGGGATCTGAACAAAGACGGTCAGATT
CAGTTCGTACTGCTGAAAGGTGAACCGGGCCATCCGGATGCAGAAGCACGTACCACTTACGTGATTAAAGAATTGAACGA
TAAAGGCATCAAAACTGAACAGTTACAGTTAGATACCGCAATGTGGGACACCGCTCAGGCGAAAGATAAGATGGACGCCT
GGCTGTCTGGCCCGAACGCCAACAAAATCGAAGTGGTTATCGCCAACAACGATGCGATGGCAATGGGCGCGGTTGAAGCG
CTGAAAGCACACAACAAGTCCAGCATTCCGGTGTTTGGCGTCGATGCGCTGCCAGAAGCGCTGGCGCTGGTGAAATCCGG
TGCACTGGCGGGCACCGTACTGAACGATGCTAACAACCAGGCGAAAGCGACCTTTGATCTGGCGAAAAACCTGGCCGATG
GTAAAGGTGCGGCTGATGGCACCAACTGGAAAATCGACAACAAAGTGGTCCGCGTACCTTATGTTGGCGTAGATAAAGAC
AACCTGGCTGAATTCAGCGAAGTCGACAGCCACAACGTCTATATCATGGCCGACAAGCAGAAGAACGGCATCAAGGTGAA
CTTCAAGATCCGCCACAACATCGAGGACGGCAGCGTGCAGCTCGCCGACCACTACCAGCAGAACACCCCCATCGGCGACG
GCCCCGTGCTGCTGCCCGACAACCACTACCTGAGCTACCAGTCCGCCCTGAGCAAAGACCCCAACGAGAAGCGCGATCAC
ATGGTCCTGCTGGAGTTCGTGACCGCCGCCGGGATCACTCTCGGCATGGACGAGCTGTACAAGTAG
```

FIG. 4A(2)

SEQ ID NO: 23
>Glifon600 v1 (1746 bp)
ATGCGGTTCGGGCTCTGGAGGTACCCACTGATGGCAACGCCGGGCTGCTGGCAGAACCCCAGATCGCCATGTTCTGTGGT
AAACTCAACATGCACAGTGAGCAAGGGCGAGGAGCTGTTCACCGGGGTGGTGCCCATCCTGGTCGAGCTGGACGGCGACG
TAAACGGCCACAAGTTCAGCGTGTCCGGCGAGGGCGAGGGCGATGCCACCTACGGCAAGCTGACCCTGAAGTTCATCTGC
ACCACCGGCAAGCTGCCCGTGCCCTGGCCCACCCTCGTGACCACCTTCGGCTACGGCCTGATGTGCTTCGCCCGCTACCC
CGACCACATGAAGCAGCACGACTTCTTCAAGTCCGCCATGCCCGAAGGCTACGTCCAGGAGCGCACCATCTTCTTCAAGG
ACGACGGCAACTACAAGACCCGCGCCGAGGTGAAGTTCGAGGGCGACACCCTGGTGAACCGCATCGAGCTGAAGGGCATC
GACTTCAAGGAGGACGGCAACATCCTGGGGCACAAGCTGGAGTTCGGCCTTCTAGGCGTTGATACTAGCATTGGTGTAAC
AATCTATAAGTACGACGATTACTATATGTCTGTAGTGCGCAAGGCTATTGAGCAAGATGCGAAAGCCGCGCCAGATGTTC
AGCTGCTGATGAATGATTCTCAGAATGACCAGTCCAAGCAGAACGATCAGATCGACGTATTGCTGGCCAAGGGGGTGAAG
GCACTGGCCATCAACCTGGTTGACCCGGCAGCTGCGGGTACGGTGATTGAGAAAGCGCGTGGGCAAAACGTGCCGGTGGT
TTTCTTCAACAAAGAACCGTCTCGTAAGGCGCTGGATAGCTACGACAAAGCCTACTACGTTGGCACTGACTCAAAAGAGT
CCGGCATTATTCAAGGCGATTTGATTGCTAAACACTGGGCGGCGAATCAGGGTTGGATCTGAACAAAGACGGTCAGATT
CAGTTCGTACTGCTGAAAGGTGAACCGGGCCATCCGGATGCAGAAGCACGTACCACTTACGTGATTAAGAATTGAACGA
TAAAGGCATCAAAACTGAACAGTTACAGTTAGATACCGCAATGTGGGACACCGCTCAGGCGAAAGATAAGATGGACGCCT
GGCTGTCTGGCCCGAACGCCAACAAAATCGAAGTGGTTATCGCCAACAACGATGCGATGGCAATGGGCGCGGTTGAAGCG
CTGAAAGCACACAACAAGTCCAGCATTCCGGTGTTTGGCGTCGATGCGCTGCCAGAAGCGCTGGCGCTGGTGAAATCCGG
TGCACTGGCGGGCACCGTACTGAACGATGCTAACAACCAGGCGAAAGCGACCTTTGATCTGGCGAAAAACCTGGCCGATG
GTAAAGGTGCGGCTGATGGCACCAACTGGAAAATCGACAACAAAGTGGTCCGCGTACCTTATGTTGGCGTAGATAAAGAC
AACCTGGCTGAATTCAGCGAAGTCGACAGCCACAACGTCTATATCATGGCCGACAAGCAGAAGAACGGCATCAAGGTGAA
CTTCAAGATCCGCCACAACATCGAGGACGGCAGCGTGCAGCTCGCCGACCACTACCAGCAGAACACCCCCATCGGCGACG
GCCCCGTGCTGCTGCCCGACAACCACTACCTGAGCTACCAGTCCGCCCTGAGCAAAGACCCCAACGAGAAGCGCGATCAC
ATGGTCCTGCTGGAGTTCGTGACCGCCGCCGGGATCACTCTCGGCATGGACGAGCTGTACAAGTAG

FIG. 4A(3)

SEQ ID NO: 24
>Glifon4000 v1 (1746 bp)
ATGCGGTTCGGGCTCTGGAGGTACCCACTGATGGCAACGCCGGGCTGCTGGCAGAACCCCAGATCGCCATGTTCTGTGGT
AAACTCAACATGCACAGTGAGCAAGGGCGAGGAGCTGTTCACCGGGGTGGTGCCCATCCTGGTCGAGCTGGACGGCGACG
TAAACGGCCACAAGTTCAGCGTGTCCGGCGAGGGCGAGGGCGATGCCACCTACGGCAAGCTGACCCTGAAGTTCATCTGC
ACCACCGGCAAGCTGCCCGTGCCCTGGCCCACCCTCGTGACCACCTTCGGCTACGGCCTGATGTGCTTCGCCCGCTACCC
CGACCACATGAAGCAGCACGACTTCTTCAAGTCCGCCATGCCCGAAGGCTACGTCCAGGAGCGCACCATCTTCTTCAAGG
ACGACGGCAACTACAAGACCCGCGCCGAGGTGAAGTTCGAGGGCGACACCCTGGTGAACCGCATCGAGCTGAAGGGCATC
GACTTCAAGGAGGACGGCAACATCCTGGGGCACAAGCTGGAGTTCGGCCTTCTAGGCGTTGATACTAGCATTGGTGTAAC
AATCTATAAGTACGACGATAACTTAATGTCTGTAGTGCGCAAGGCTATTGAGCAAGATGCGAAAGCCGCGCCAGATGTTC
AGCTGCTGATGAATGATTCTCAGAATGACCAGTCCAAGCAGAACGATCAGATCGACGTATTGCTGGCCAAGGGGGTGAAG
GCACTGGCCATCAACCTGGTTGACCCGGCAGCTGCGGGTACGGTGATTGAGAAAGCGCGTGGGCAAAACGTGCCGGTGGT
TTTCTTCAACAAAGAACCGTCTCGTAAGGCGCTGGATAGCTACGACAAAGCCTACTACGTTGGCACTGACTCAAAAGAGT
CCGGCATTATTCAAGGCGATTTGATTGCTAAACACTGGGCGGCGAATCAGGGTTGGATCTGAACAAAGACGGTCAGATT
CAGTTCGTACTGCTGAAAGGTGAACCGGGCCATCCGGATGCAGAAGCACGTACCACTTACGTGATTAAGAATTGAACGA
TAAAGGCATCAAAACTGAACAGTTACAGTTAGATACCGCAATGTGGGACACCGCTCAGGCGAAAGATAAGATGGACGCCT
GGCTGTCTGGCCCGAACGCCAACAAAATCGAAGTGGTTATCGCCAACAACGATGCGATGGCAATGGGCGCGGTTGAAGCG
CTGAAAGCACACAACAAGTCCAGCATTCCGGTGTTTGGCGTCGATGCGCTGCCAGAAGCGCTGGCGCTGGTGAAATCCGG
TGCACTGGCGGGCACCGTACTGAACGATGCTAACAACCAGGCGAAAGCGACCTTTGATCTGGCGAAAAACCTGGCCGATG
GTAAAGGTGCGGCTGATGGCACCAACTGGAAAATCGACAACAAAGTGGTCCGCGTACCTTATGTTGGCGTAGATAAAGAC
AACCTGGCTGAATTCAGCGAAGTCGACAGCCACAACGTCTATATCATGGCCGACAAGCAGAAGAACGGCATCAAGGTGAA
CTTCAAGATCCGCCACAACATCGAGGACGGCAGCGTGCAGCTCGCCGACCACTACCAGCAGAACACCCCCATCGGCGACG
GCCCCGTGCTGCTGCCCGACAACCACTACCTGAGCTACCAGTCCGCCCTGAGCAAAGACCCCAACGAGAAGCGCGATCAC
ATGGTCCTGCTGGAGTTCGTGACCGCCGCCGGGATCACTCTCGGCATGGACGAGCTGTACAAGTAG

FIG. 4A(4)

SEQ ID NO: 25
>Glifon5 v3 DNA sequence
ATGGTGAGCAAGGGCGAGGAGCTGTTCACCGGGGTGGTGCCCATCCTGGTCGAGCTGGACGGCGACGTAAACGGCCACAAGTTCAG
CGTGTCCGGCGAGGGCGAGGGCGATGCCACCTACGGCAAGCTGACCCTGAAGTTCATCTGCACCACCGGCAAGCTGCCCGTGCCCT
GGCCCACCCTCGTGACCACCTTCGGCTACGGCCTGATGTGCTTCGCCCGCTACCCCGACCACATGAAGCAGCACGACTTCTTCAAG
TCCGCCATGCCCGAAGGCTACGTCCAGGAGCGCACCATCTTCTTCAAGGACGACGGCAACTACAAGACCCGCGCCGAGGTGAAGTT
CGAGGGCGACACCCTGGTGAACCGCATCGAGCTGAAGGGCATCGACTTCAAGGAGGACGGCAACATCCTGGGGCACAAGCTGGAGT
TTGGTCTCCTGGGAGTTGATACTAGCATTGGTGTAACAATCTATAAGTACGACGATAACTTTATGTCTGTAGTGCGCAAGGCTATT
GAGCAAGATGCGAAAGCCGCGCCAGATGTTCAGCTGCTGATGAATGATTCTCAGAATGACCAGTCCAAGCAGAACGATCAGATCGA
CGTATTGCTGGCGAAAGGGGTGAAGGCACTGGCAATCAACCTGGTTGACCCGGCAGCTGCGGGTACGGTGATTGAGAAAGCGCGTG
GGCAAAACGTGCCGGTGGTTTTCTTCAACAAAGAACCGTCTCGTAAGGCGCTGGATAGCTACGACAAAGCCTACTACGTTGGCACT
GACTCCAAAGAGTCCGGCATTATTCAAGGCGATTTGATTGCTAAACACTGGGCGGCGAATCAGGGTTGGGATCTGAACAAAGACGG
TCAGATTCAGTTCGTACTGCTGAAAGGTGAACCGGGCCATCCGGATGCAGAAGCACGTACCACTTACGTGATTAAGAATTGAACG
ATAAAGGCATCAAAACTGAACAGTTACAGTTAGATACCGCAATGTGGGACACCGCTCAGGCGAAAGATAAGATGGACGCCTGGCTG
TCTGGCCCGAACGCCAACAAAATCGAAGTGGTTATCGCCAACAACGATGCGATGGCAATGGGCGCGGTTGAAGCGCTGAAAGCACA
CAACAAGTCCAGCATTCCGGTGTTTGGCGTCGATGCGCTGCCAGAAGCGCTGGCGCTGGTGAAATCCGGTGCACTGGCGGGCACCG
TACTGAACGATGCTAACAACCAGGCGAAAGCGACCTTTGATCTGGCGAAAAACCTGGCCGATGGTAAAGGTGCGGCTGATGGCACC
AACTGGAAAATCGACAACAAAGTGGTCCGCGTACCTTATGTTGGCGTAGATAAAGACAACCTGGCTGAGTTCAGCGAGGTGGATAG
CCACAACGTCTATATCATGGCCGACAAGCAGAAGAACGGCATCAAGGTGAACTTCAAGATCCGCCACAACATCGAGGACGGCAGCG
TGCAGCTCGCCGACCACTACCAGCAGAACACCCCCATCGGCGACGGCCCCGTGCTGCTGCCCGACAACCACTACCTGAGCTACCAG
TCCGCCCTGAGCAAAGACCCCAACGAGAAGCGCGATCACATGGTCCTGCTGGAGTTCGTGACCGCCGCCGGGATCACTCTCGGCAT
GGACGAGCTGTACAAGTAA

FIG. 4A(5)

SEQ ID NO: 26
>Glifon50 v3 DNA sequence
ATGGTGAGCAAGGGCGAGGAGCTGTTCACCGGGGTGGTGCCCATCCTGGTCGAGCTGGACGGCGACGTAAACGGCCACAAGTTCAG
CGTGTCCGGCGAGGGCGAGGGCGATGCCACCTACGGCAAGCTGACCCTGAAGTTCATCTGCACCACCGGCAAGCTGCCCGTGCCCT
GGCCCACCCTCGTGACCACCTTCGGCTACGGCCTGATGTGCTTCGCCCGCTACCCCGACCACATGAAGCAGCACGACTTCTTCAAG
TCCGCCATGCCCGAAGGCTACGTCCAGGAGCGCACCATCTTCTTCAAGGACGACGGCAACTACAAGACCCGCGCCGAGGTGAAGTT
CGAGGGCGACACCCTGGTGAACCGCATCGAGCTGAAGGGCATCGACTTCAAGGAGGACGGCAACATCCTGGGGCACAAGCTGGAGT
TTGGTCTCCTGGGAGTTGATACTAGCATTGGTGTAACAATCTATAAGTACGACGATTATTATATGTCTGTAGTGCGCAAGGCTATT
GAGCAAGATGCGAAAGCCGCGCCAGATGTTCAGCTGCTGATGAATGATTCTCAGAATGACCAGTCCAAGCAGAACGATCAGATCGA
CGTATTGCTGGCGAAAGGGGTGAAGGCACTGGCAATCAACCTGGTTGACCCGGCAGCTGCGGGTACGGTGATTGAGAAAGCGCGTG
GGCAAAACGTGCCGGTGGTTTTCTTCAACAAAGAACCGTCTCGTAAGGCGCTGGATAGCTACGACAAAGCCTACTACGTTGGCACT
GACTCCAAAGAGTCCGGCATTATTCAAGGCGATTTGATTGCTAAACACTGGGCGGCGAATCAGGGTTGGGATCTGAACAAAGACGG
TCAGATTCAGTTCGTACTGCTGAAAGGTGAACCGGGCCATCCGGATGCAGAAGCACGTACCACTTACGTGATTAAGAATTGAACG
ATAAAGGCATCAAAACTGAACAGTTACAGTTAGATACCGCAATGTGGGACACCGCTCAGGCGAAAGATAAGATGGACGCCTGGCTG
TCTGGCCCGAACGCCAACAAAATCGAAGTGGTTATCGCCAACAACGATGCGATGGCAATGGGCGCGGTTGAAGCGCTGAAAGCACA
CAACAAGTCCAGCATTCCGGTGTTTGGCGTCGATGCGCTGCCAGAAGCGCTGGCGCTGGTGAAATCCGGTGCACTGGCGGGCACCG
TACTGAACGATGCTAACAACCAGGCGAAAGCGACCTTTGATCTGGCGAAAAACCTGGCCGATGGTAAAGGTGCGGCTGATGGCACC
AACTGGAAAATCGACAACAAAGTGGTCCGCGTACCTTATGTTGGCGTAGATAAAGACAACCTGGCTGAGTTCAGCGAGGTGGATAG
CCACAACGTCTATATCATGGCCGACAAGCAGAAGAACGGCATCAAGGTGAACTTCAAGATCCGCCACAACATCGAGGACGGCAGCG
TGCAGCTCGCCGACCACTACCAGCAGAACACCCCCATCGGCGACGGCCCCGTGCTGCTGCCCGACAACCACTACCTGAGCTACCAG
TCCGCCCTGAGCAAAGACCCCAACGAGAAGCGCGATCACATGGTCCTGCTGGAGTTCGTGACCGCCGCCGGGATCACTCTCGGCAT
GGACGAGCTGTACAAGTAA

FIG. 4A(6)

```
SEQ ID NO: 27
>Glifon600 v3 DNA sequence
ATGGTGAGCAAGGGCGAGGAGCTGTTCACCGGGGTGGTGCCCATCCTGGTCGAGCTGGACGGCGACGTAAACGGCCACAAGTTCAG
CGTGTCCGGCGAGGGCGAGGGCGATGCCACCTACGGCAAGCTGACCCTGAAGTTCATCTGCACCACCGGCAAGCTGCCCGTGCCCT
GGCCCACCCTCGTGACCACCTTCGGCTACGGCCTGATGTGCTTCGCCCGCTACCCCGACCACATGAAGCAGCACGACTTCTTCAAG
TCCGCCATGCCCGAAGGCTACGTCCAGGAGCGCACCATCTTCTTCAAGGACGACGGCAACTACAAGACCCGCGCCGAGGTGAAGTT
CGAGGGCGACACCCTGGTGAACCGCATCGAGCTGAAGGGCATCGACTTCAAGGAGGACGGCAACATCCTGGGGCACAAGCTGGAGT
TTGGTCTCCTGGGAGTTGATACTAGCATTGGTGTAACAATCTATAAGTACGACGATTATTATATGTCTGTAGTGCGCAAGGCTATT
GAGCAAGATGCGAAAGCCGCGCCAGATGTTCAGCTGCTGATGAATGATTCTCAGAATGACCAGTCCAAGCAGAACGATCAGATCGA
CGTATTGCTGGCGAAAGGGGTGAAGGCACTGGCAATCAACCTGGTTGACCCGGCAGCTGCGGGTACGGTGATTGAGAAAGCGCGTG
GGCAAAACGTGCCGGTGGTTTTCTTCAACAAAGAACCGTCTCGTAAGGCGCTGGATAGCTACGACAAAGCCTACTACGTTGGCACT
GACTCCAAAGAGTCCGGCATTATTCAAGGCGATTTGATTGCTAAACACTGGGCGGCGAATCAGGGTTGGGATCTGAACAAAGACGG
TCAGATTCAGTTCGTACTGCTGAAAGGTGAACCGGGCCATCCGGATGCAGAAGCACGTACCACTTACGTGATTAAAGAATTGAACG
ATAAAGGCATCAAAACTGAACAGTTACAGTTAGATACCGCAATGTGGGACACCGCTCAGGCGAAAGATAAGATGGACGCCTGGCTG
TCTGGCCCGAACGCCAACAAAATCGAAGTGGTTATCGCCAACAACGATGCGATGGCAATGGGCGCGGTTGAAGCGCTGAAAGCACA
CAACAAGTCCAGCATTCCGGTGTTTGGCGTCGATGCGCTGCCAGAAGCGCTGGCGCTGGTGAAATCCGGTGCACTGGCGGGCACCG
TACTGAACGATGCTAACAACCAGGCGAAAGCGACCTTTGATCTGGCGAAAAACCTGGCCGATGGTAAAGGTGCGGCTGATGGCACC
AACTGGAAAATCGACAACAAAGTGGTCCGCGTACCTTATGTTGGCGTAGATAAAGACAACCTGGCTGAGTTCAGCGAGGTGGATAG
CCACAACGTCTATATCATGGCCGACAAGCAGAAGAACGGCATCAAGGTGAACTTCAAGATCCGCCACAACATCGAGGACGGCAGCG
TGCAGCTCGCCGACCACTACCAGCAGAACACCCCCATCGGCGACGGCCCCGTGCTGCTGCCCGACAACCACTACCTGAGCTACCAG
TCCGCCCTGAGCAAAGACCCCAACGAGAAGCGCGATCACATGGTCCTGCTGGAGTTCGTGACCGCCGCCGGGATCACTCTCGGCAT
GGACGAGCTGTACAAGTAA
```

FIG. 4A(7)

```
SEQ ID NO: 28
>Glifon4000 v3 DNA sequence
ATGGTGAGCAAGGGCGAGGAGCTGTTCACCGGGGTGGTGCCCATCCTGGTCGAGCTGGACGGCGACGTAAACGGCCACAAGTTCAG
CGTGTCCGGCGAGGGCGAGGGCGATGCCACCTACGGCAAGCTGACCCTGAAGTTCATCTGCACCACCGGCAAGCTGCCCGTGCCCT
GGCCCACCCTCGTGACCACCTTCGGCTACGGCCTGATGTGCTTCGCCCGCTACCCCGACCACATGAAGCAGCACGACTTCTTCAAG
TCCGCCATGCCCGAAGGCTACGTCCAGGAGCGCACCATCTTCTTCAAGGACGACGGCAACTACAAGACCCGCGCCGAGGTGAAGTT
CGAGGGCGACACCCTGGTGAACCGCATCGAGCTGAAGGGCATCGACTTCAAGGAGGACGGCAACATCCTGGGGCACAAGCTGGAGT
TTGGTCTCCTGGGAGTTGATACTAGCATTGGTGTAACAATCTATAAGTACGACGATAACTTGATGTCTGTAGTGCGCAAGGCTATT
GAGCAAGATGCGAAAGCCGCGCCAGATGTTCAGCTGCTGATGAATGATTCTCAGAATGACCAGTCCAAGCAGAACGATCAGATCGA
CGTATTGCTGGCGAAAGGGGTGAAGGCACTGGCAATCAACCTGGTTGACCCGGCAGCTGCGGGTACGGTGATTGAGAAAGCGCGTG
GGCAAAACGTGCCGGTGGTTTTCTTCAACAAAGAACCGTCTCGTAAGGCGCTGGATAGCTACGACAAAGCCTACTACGTTGGCACT
GACTCCAAAGAGTCCGGCATTATTCAAGGCGATTTGATTGCTAAACACTGGGCGGCGAATCAGGGTTGGGATCTGAACAAAGACGG
TCAGATTCAGTTCGTACTGCTGAAAGGTGAACCGGGCCATCCGGATGCAGAAGCACGTACCACTTACGTGATTAAAGAATTGAACG
ATAAAGGCATCAAAACTGAACAGTTACAGTTAGATACCGCAATGTGGGACACCGCTCAGGCGAAAGATAAGATGGACGCCTGGCTG
TCTGGCCCGAACGCCAACAAAATCGAAGTGGTTATCGCCAACAACGATGCGATGGCAATGGGCGCGGTTGAAGCGCTGAAAGCACA
CAACAAGTCCAGCATTCCGGTGTTTGGCGTCGATGCGCTGCCAGAAGCGCTGGCGCTGGTGAAATCCGGTGCACTGGCGGGCACCG
TACTGAACGATGCTAACAACCAGGCGAAAGCGACCTTTGATCTGGCGAAAAACCTGGCCGATGGTAAAGGTGCGGCTGATGGCACC
AACTGGAAAATCGACAACAAAGTGGTCCGCGTACCTTATGTTGGCGTAGATAAAGACAACCTGGCTGAGTTCAGCGAGGTGGATAG
CCACAACGTCTATATCATGGCCGACAAGCAGAAGAACGGCATCAAGGTGAACTTCAAGATCCGCCACAACATCGAGGACGGCAGCG
TGCAGCTCGCCGACCACTACCAGCAGAACACCCCCATCGGCGACGGCCCCGTGCTGCTGCCCGACAACCACTACCTGAGCTACCAG
TCCGCCCTGAGCAAAGACCCCAACGAGAAGCGCGATCACATGGTCCTGCTGGAGTTCGTGACCGCCGCCGGGATCACTCTCGGCAT
GGACGAGCTGTACAAGTAA
```

FIG. 4A(8)

```
SEQ ID NO: 29
>FGBP_3.1µM  (1671 bp)
ATGGCTGATACTCGCATTGGTGTAACAATCTATAAGTATGATGATAACTTTATGTCTGTAGTGCGCAAGGCTATTGAGCA
AGATGCGAAAGCCGCGCCAGATGTTCAGCTGCTGATGAATGATTCTCAGAATGACCAGTCCAAGCAGAACGATCAGATCG
ACGTATTGCTGGCGAAAGGGGTGAAGGCACTGGCAATCAACCTGGTTGACCCGGCAGCTGCGGGTACGGTGATTGAGAAA
GCGCGTGGGCAAAACGTGCCGGTGGTTTTCTTCAACAAAGAACCGTCTCGTAAGGCGCTGGATAGCTACGACAAAGCCTA
CTACGTTGGCACTGACTCCAAAGAGTCCGGCATTATTCAAGGCGATTTGATTGCTAAACACTGGGCGGCGAATCAGGGTT
GGGATCTGAACAAAGACGGTCAGATTCAGTTCGTACTGCTGAAAGGTGAACCGGGCCATCCGGATGCAGAAGCACGTACC
ACTTACGTGATTAAAGAATTGAACGATAAAGGCATCAAAACTGAACAGTTACAGTTAGATACCGCAATGTGGGACACCGC
TCAGGCGAAAGATAAGATGGACGCCTGGCTGTCTGGCCCGAACGCCAACAAAATCGAAGTGGTTATCGCCAACAACGATG
CGATGGCAATGGGCGCGGTTGAAGCGCTGAAAGCACACAACAAGTCCAGCATTCCGGTGTTTGGCGTCGATGCGCTGCCA
GAAGCGCTGGCGCTGGTGAAATCCGGTGCACTGGCGGGCACCGTACTGAACGATGCTAACAACCAGGCGAAAGCGACCTT
TGATCTGGCGAAAAACCTGGCCGATGGTAAAGGTGCGGCTGATGGCACCAACTGGAAAATCGACAACAAAGTGGTCCGCG
TACCTTACAACAGCGACAACGTCTATATCATGGCCGACAAGCAGAAGAACGGCATCAAGGCCTACTTCAAGATCCGCCAC
AACGTCGAGGACGGCAGCGTGCAGCTCGCCGACCACTACCAGCAGAACACCCCCATCGGCGACGGCCCCGTGCTGCTGCC
CGACAACCACTACCTGAGCTTCCAGTCCGTCCTGAGCAAAGACCCCAACGAGAAGCGCGATCACATGGTCCTGCTGGAGT
TCGTGACCGCCGCCGGGATCACTCTCGGCATGGACGAGCTGTACAACGTGGATGGCGGTAGCGGTGGCACCGGCAGCAAG
GGCGAGGAGCTGTTCACCGGGGTGGTGCCCATCCTGGTCGAGCTGGACGGCGACGTAAACGGCCACAAGTTCAGCGTGTC
CGGCGAGGGCGAGGGCGATGCCACCTACGGCAAGCTGACCCTGAAGCTGATCTGCACCACCGGCAAGCTGCCCGTGCCCT
GGCCCACCCTCGTGACCACCCTCGGCTACGGCCTGAAGTGCTTCGCCCGCTACCCCGACCACATGAAGCAGCACGACTTC
TTCAAGTCCGCCATGCCCGAAGGCTACGTCCAGGAGCGCACCATCTTCTTCAAGGACGACGGCAACTACAAGACCCGCGC
CGAGGTGAAGTTCGAGGGCGACACCCTGGTGAACCGCATCGAGCTGAAGGGCATCGGCTTCAAGGAGGACGGCAACATCC
TGGGGCACAAGCTGGAGTACAACTATGTTGGCGTAGATAAAGACAACCTGGCTGAATTCAGCAAGAAATAA
```

FIG. 5A(1)

```
SEQ ID NO: 30
>FGBP_27µM  (1650 bp)
ATGGCTGATACTCGCATTGGTGTAACAATCTATAAGTATGATGATAACTTTATGTCTGTAGTGCGCAAGGCTATTGAGCA
AGATGCGAAAGCCGCGCCAGATGTTCAGCTGCTGATGAATGATTCTCAGAATGACCAGTCCAAGCAGAACGATCAGATCG
ACGTATTGCTGGCGAAAGGGGTGAAGGCACTGGCAATCAACCTGGTTGACCCGGCAGCTGCGGGTACGGTGATTGAGAAA
GCGCGTGGGCAAAACGTGCCGGTGGTTTTCTTCAACAAAGAACCGTCTCGTAAGGCGCTGGATAGCTACGACAAAGCCTA
CTACGTTGGCACTGACTCCAAAGAGTCCGGCATTATTCAAGGCGATTTGATTGCTAAACACTGGGCGGCGAATCAGGGTT
GGGATCTGAACAAAGACGGTCAGATTCAGTTCGTACTGCTGAAAGGTGAACCGGGCCATCCGGATGCAGAAGCACGTACC
ACTTACGTGATTAAAGAATTGAACGATAAAGGCATCAAAACTGAACAGTTACAGTTAGATACCGCAATGTGGGACACCGC
TCAGGCGAAAGATAAGATGGACGCCTGGCTGTCTGGCCCGAACGCCAACAAAATCGAAGTGGTTATCGCCAACAACGATG
CGATGGCAATGGGCGCGGTTGAAGCGCTGAAAGCACACAACAAGTCCAGCATTCCGGTGTTTGGCGTCGATGCGCTGCCA
GAAGCGCTGGCGCTGGTGAAATCCGGTGCACTGGCGGGCACCGTACTGAACGATGCTAACAACCAGGCGAAAGCGACCTT
TGATCTGGCGAAAAACCTGGCCGATGGTAAAGGTGCGGCTGATGGCACCAACTGGAAAATCGACAACAAAGTGGTCCGCG
TACCTGACAACGTCTATATCATGGCCGACAAGCAGAAGAACGGCATCAAGGCCTACTTCAAGATCCGCCACAACGTCGAG
GACGGCAGCGTGCAGCTCGCCGACCACTACCAGCAGAACACCCCCATCGGCGACGGCCCCGTGCTGCTGCCCGACAACCA
CTACCTGAGCTTCCAGTCCGTCCTGAGCAAAGACCCCAACGAGAAGCGCGATCACATGGTCCTGCTGGAGTTCGTGACCG
CCGCCGGGATCACTCTCGGCATGGACGAGCTGTACAACGTGGATGGCGGTAGCGGTGGCACCGGCAGCAAGGGCGAGGAG
CTGTTCACCGGGGTGGTGCCCATCCTGGTCGAGCTGGACGGCGACGTAAACGGCCACAAGTTCAGCGTGTCCGGCGAGGG
CGAGGGCGATGCCACCTACGGCAAGCTGACCCTGAAGCTGATCTGCACCACCGGCAAGCTGCCCGTGCCCTGGCCCACCC
TCGTGACCACCCTCGGCTACGGCCTGAAGTGCTTCGCCCGCTACCCCGACCACATGAAGCAGCACGACTTCTTCAAGTCC
GCCATGCCCGAAGGCTACGTCCAGGAGCGCACCATCTTCTTCAAGGACGACGGCAACTACAAGACCCGCGCCGAGGTGAA
GTTCGAGGGCGACACCCTGGTGAACCGCATCGAGCTGAAGGGCATCGGCTTCAAGGAGGACGGCAACATCCTGGGGCACA
AGTATGTTGGCGTAGATAAAGACAACCTGGCTGAATTCAGCAAGAAATAA
```

FIG. 5A(2)

SEQ ID NO: 31
>FGBP_380µM  (1650 bp)
ATGGCTGATACTCGCATTGGTGTAACAATCTATAAGTATGATGATAACTTTATGTCTGTAGTGCGCAAGGCTATTGAGCA
AGATGCGAAAGCCGCGCCAGATGTTCAGCTGCTGATGAATGATTCTCAGAATGACCAGTCCAAGCAGAACGATCAGATCG
ACGTATTGCTGGCGAAAGGGGTGAAGGCACTGGCAATCAACCTGGTTGACCCGGCAGCTGCGGGTACGGTGATTGAGAAA
GCGCGTGGGCAAAACGTGCCGGTGGTTTTCTTCAACAAAGAACCGTCTCGTAAGGCGCTGGATAGCTACGACAAAGCCTA
CTACGTTGGCACTGACTCCAAAGAGTCCGGCATTATTCAAGGCGATTTGATTGCTAAACACTGGGCGGCGAATCAGGGTT
GGGATCTGAACAAAGACGGTCAGATTCAGTTCGTACTGCTGAAAGGTGAACCGGGCCATCCGGATGCAGAAGCACGTACC
ACTTACGTGATTAAAGAATTGAACGATAAAGGCATCAAAACTGAACAGTTACAGTTAGATACCGCAATGTGGGACACCGC
TCAGGCGAAAGATAAGATGGACGCCTGGCTGTCTGGCCCGAACGCCAACAAAATCGAAGTGGTTATCGCCAACAACGATG
CGATGGCAATGGGCGCGGTTGAAGCGCTGAAAGCACACAACAAGTCCAGCATTCCGGTGTTTGGCGTCGATGCGCTGCCA
GAAGCGCTGGCGCTGGTGAAATCCGGTGCACTGGCGGGCACCGTACTGAGCGATGCTAACAACCAGGCGAAAGCGACCTT
TGATCTGGCGAAAAACCTGGCCGATGGTAAAGGTGCGGCTGATGGCACCAACTGGAAAATCGACAACAAAGTGGTCCGCG
TACCTGACAACGTCTATATCATGGCCGACAAGCAGAAGAACGGCATCAAGGCCTACTTCAAGATCCGCCACAACGTCGAG
GACGGCAGCGTGCAGCTCGCCGACCACTACCAGCAGAACACCCCCATCGGCGACGGCCCCGTGCTGCTGCCCGACAACCA
CTACCTGAGCTTCCAGTCCGTCCTGAGCAAAGACCCCAACGAGAAGCGCGATCACATGGTCCTGCTGGAGTTCGTGACCG
CCGCCGGGATCACTCTCGGCATGGACGAGCTGTACAACGTGGATGGCGGTAGCGGTGGCACCGGCAGCAAGGGCGAGGAG
CTGTTCACCGGGGTGGTGCCCATCCTGGTCGAGCTGGACGGCGACGTAAACGGCCACAAGTTCAGCGTGTCCGGCGAGGG
CGAGGGCGATGCCACCTACGGCAAGCTGACCCTGAAGCTGATCTGCACCACCGGCAAGCTGCCCGTGCCCTGGCCCACCC
TCGTGACCACCCTCGGCTACGGCCTGAAGTGCTTCGCCCGCTACCCCGACCACATGAAGCAGCACGACTTCTTCAAGTCC
GCCATGCCCGAAGGCTACGTCCAGGAGCGCACCATCTTCTTCAAGGACGACGGCAACTACAAGACCCGCGCCGAGGTGAA
GTTCGAGGGCGACACCCTGGTGAACCGCATCGAGCTGAAGGGCATCGGCTTCAAGGAGGACGGCAACATCCTGGGGCACA
AGTATGTTGGCGTAGATAAAGACAACCTGGCTGAATTCAGCAAGAAATAA

FIG. 5A(3)

SEQ ID NO: 32
>FGBP_1mM  (1650 bp)
ATGGCTGATACTCGCATTGGTGTAACAATCTATAAGTATGATGATAACTTTATGTCTGTAGTGCGCAAGGCTATTGAGCA
AGATGCGAAAGCCGCGCCAGATGTTCAGCTGCTGATGAATGATTCTCAGAATGACCAGTCCAAGCAGAACGATCAGATCG
ACGTATTGCTGGCGAAAGGGGTGAAGGCACTGGCAATCAACCTGGTTGACCCGGCAGCTGCGGGTACGGTGATTGAGAAA
GCGCGTGGGCAAAACGTGCCGGTGGTTTTCTTCAACAAAGAACCGTCTCGTAAGGCGCTGGATAGCTACGACAAAGCCTA
CTACGTTGGCACTGACTCCAAAGAGTCCGGCATTATTCAAGGCGATTTGATTGCTAAACACTGGGCGGCGAATCAGGGTT
GGGATCTGAACAAAGACGGTCAGATTCAGTTCGTACTGCTGAAAGGTGAACCGGGCCATCCGGATGCAGAAGCACGTACC
ACTTACGTGATTAAAGAATTGAACGATAAAGGCATCAAAACTGAACAGTTACAGTTAGATACCGCAATGTGGGACACCGC
TCAGGCGAAAGATAAGATGGACGCCTGGCTGTCTGGCCCGAACGCCAACAAAATCGAAGTGGTTATCGCCAACAACGATG
CGATGGCAATGGGCGCGGTTGAAGCGCTGAAAGCACACAACAAGTCCAGCATTCCGGTGTTTGGCGTCGATGCGTCTCCA
GAAGCGCTGGCGCTGGTGAAATCCGGTGCACTGGCGGGCACCGTACTGACGATGCTAACAACCAGGCGAAAGCGACCTT
TGATCTGGCGAAAAACCTGGCCGATGGTAAAGGTGCGGCTGATGGCACCAACTGGAAAATCGACAACAAAGTGGTCCGCG
TACCTGACAACGTCTATATCATGGCCGACAAGCAGAAGAACGGCATCAAGGCCTACTTCAAGATCCGCCACAACGTCGAG
GACGGCAGCGTGCAGCTCGCCGACCACTACCAGCAGAACACCCCCATCGGCGACGGCCCCGTGCTGCTGCCCGACAACCA
CTACCTGAGCTTCCAGTCCGTCCTGAGCAAAGACCCCAACGAGAAGCGCGATCACATGGTCCTGCTGGAGTTCGTGACCG
CCGCCGGGATCACTCTCGGCATGGACGAGCTGTACAACGTGGATGGCGGTAGCGGTGGCACCGGCAGCAAGGGCGAGGAG
CTGTTCACCGGGGTGGTGCCCATCCTGGTCGAGCTGGACGGCGACGTAAACGGCCACAAGTTCAGCGTGTCCGGCGAGGG
CGAGGGCGATGCCACCTACGGCAAGCTGACCCTGAAGCTGATCTGCACCACCGGCAAGCTGCCCGTGCCCTGGCCCACCC
TCGTGACCACCCTCGGCTACGGCCTGAAGTGCTTCGCCCGCTACCCCGACCACATGAAGCAGCACGACTTCTTCAAGTCC
GCCATGCCCGAAGGCTACGTCCAGGAGCGCACCATCTTCTTCAAGGACGACGGCAACTACAAGACCCGCGCCGAGGTGAA
GTTCGAGGGCGACACCCTGGTGAACCGCATCGAGCTGAAGGGCATCGGCTTCAAGGAGGACGGCAACATCCTGGGGCACA
AGTATGTTGGCGTAGATAAAGACAACCTGGCTGAATTCAGCAAGAAATAA

FIG. 5A(4)

```
SEQ ID NO: 33
>FGBP_3.2mM  (1650 bp)
ATGGCTGATACTCGCATTGGTGTAACAATCTATAAGTATGATGATAACTTTATGTCTGTAGTGCGCAAGGCTATTGAGCA
AGATGCGAAAGCCGCGCCAGATGTTCAGCTGCTGATGAATGATTCTCAGAATGACCAGTCCAAGCAGAACGATCAGATCG
ACGTATTGCTGGCGAAAGGGGTGAAGGCACTGGCAATCAACCTGGTTGACCCGGCAGCTGCGGGTACGGTGATTGAGAAA
GCGCGTGGGCAAAACGTGCCGGTGGTTTTCTTCAACAAAGAACCGTCTCGTAAGGCGCTGGATAGCTACGACAAAGCCTA
CTACGTGGCACTGACTCCAAAGAGTCCGGCATTATTCAAGGCGATTTGATTGCTAAACACTGGGCGGCGAATCAGGGTT
GGGATCTGAACAAAGACGGTCAGATTCAGTTCGTACTGCTGAAAGGTGAACCGGGCCATCCGGATGCAGAAGCACGTACC
ACTTACGTGATTAAAGAATTGAACGATAAAGGCATCAAAACTGAACAGTTACAGTTAGATACCGCAATGTGGGACACCGC
TCAGGCGAAAGATAAGATGGACGCCTGGCTGTCTGGCCCGAACGCCAACAAAATCGAAGTGGTTATCGCCAACAACGATC
GGATGGCAATGGGCGCGGTTGAAGCGCTGAAAGCACACAACAAGTCCAGCATTCCGGTGTTTGGCGTCGATGCGCTGCCA
GAAGCGCTGGCGCTGGTGAAATCCGGTGCACTGGCGGGCACCGTACTGAACGATGCTAACAACCAGGCGAAAGCGACCTT
TGATCTGGCGAAAAACCTGGCCGATGGTAAAGGTGCGGCTGATGGCACCAACTGGAAAATCGACAACAAAGTGGTCCGCG
TACCTGACAACGTCTATATCATGGCCGACAAGCAGAAGAACGGCATCAAGGCCTACTTCAAGATCCGCCACAACGTCGAG
GACGGCAGCGTGCAGCTCGCCGACCACTACCAGCAGAACACCCCCATCGGCGACGGCCCCGTGCTGCTGCCCGACAACCA
CTACCTGAGCTTCCAGTCCGTCCTGAGCAAAGACCCCAACGAGAAGCGCGATCACATGGTCCTGCTGGAGTTCGTGACCG
CCGCCGGGATCACTCTCGGCATGGACGAGCTGTACAACGTGGATGGCGGTAGCGGTGGCACCGGCAGCAAGGGCGAGGAG
CTGTTCACCGGGGTGGTGCCCATCCTGGTCGAGCTGGACGGCGACGTAAACGGCCACAAGTTCAGCGTGTCCGGCGAGGG
CGAGGGCGATGCCACCTACGGCAAGCTGACCCTGAAGCTGATCTGCACCACCGGCAAGCTGCCCGTGCCCTGGCCCACCC
TCGTGACCACCCTCGGCTACGGCCTGAAGTGCTTCGCCCGCTACCCCGACCACATGAAGCAGCACGACTTCTTCAAGTCC
GCCATGCCCGAAGGCTACGTCCAGGAGCGCACCATCTTCTTCAAGGACGACGGCAACTACAAGACCCGCGCCGAGGTGAA
GTTCGAGGGCGACACCCTGGTGAACCGCATCGAGCTGAAGGGCATCGGCTTCAAGGAGGACGGCAACATCCTGGGGCACA
AGTATGTTGGCGTAGATAAAGACAACCTGGCTGAATTCAGCAAGAAATAA
```

FIG. 5A(5)

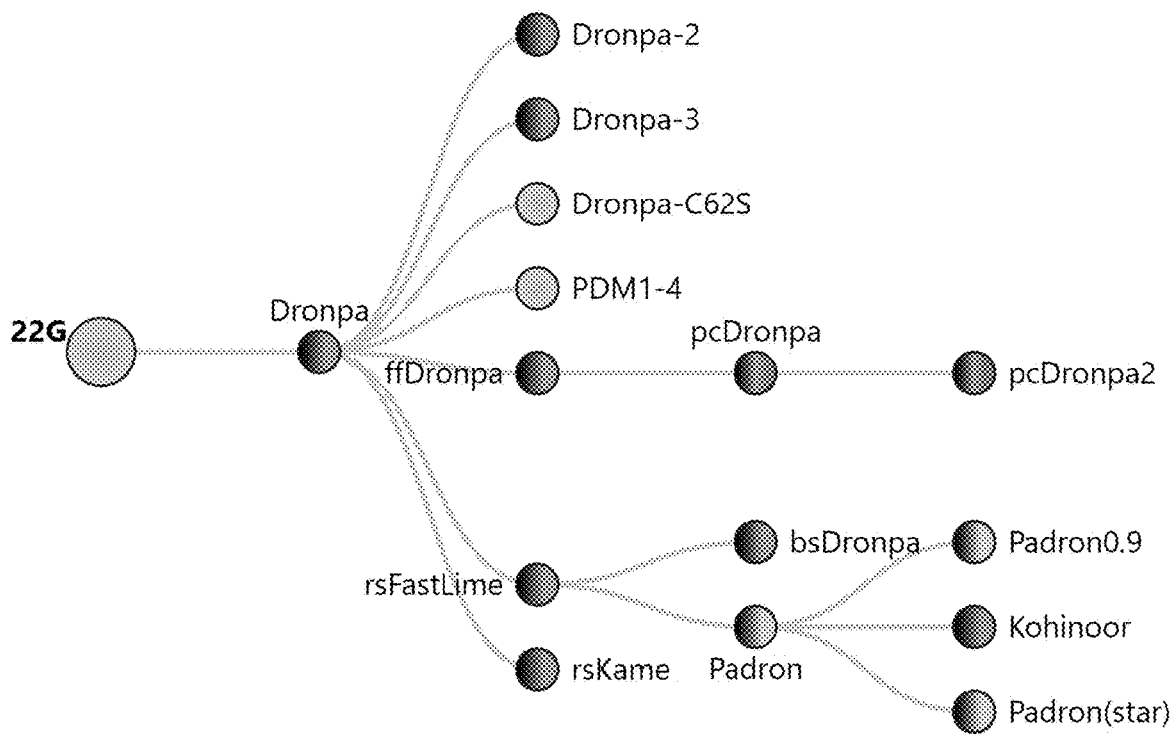

FIG. 6A(1)

FIG. 6A(2)
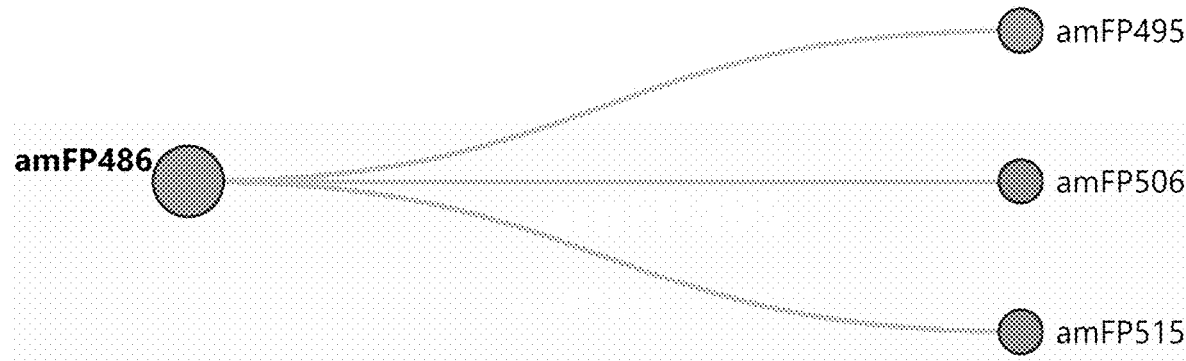
FIG. 6A(3)
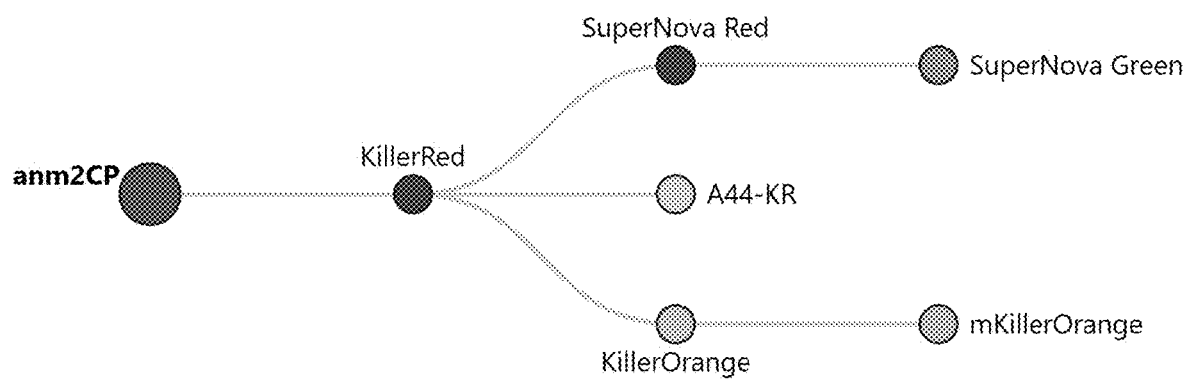
FIG. 6A(4)
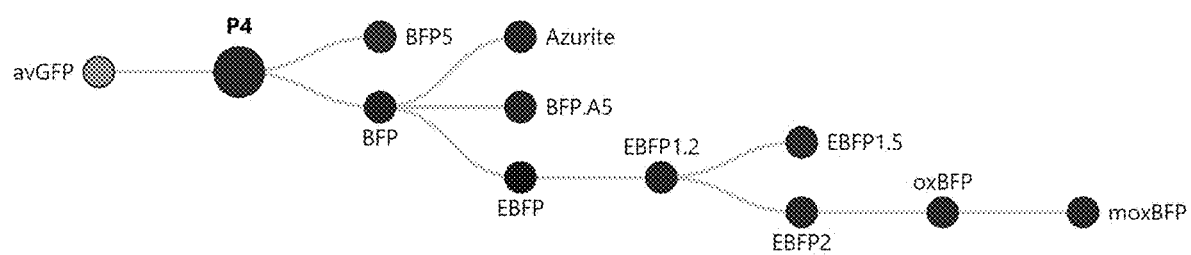
FIG. 6A(5)

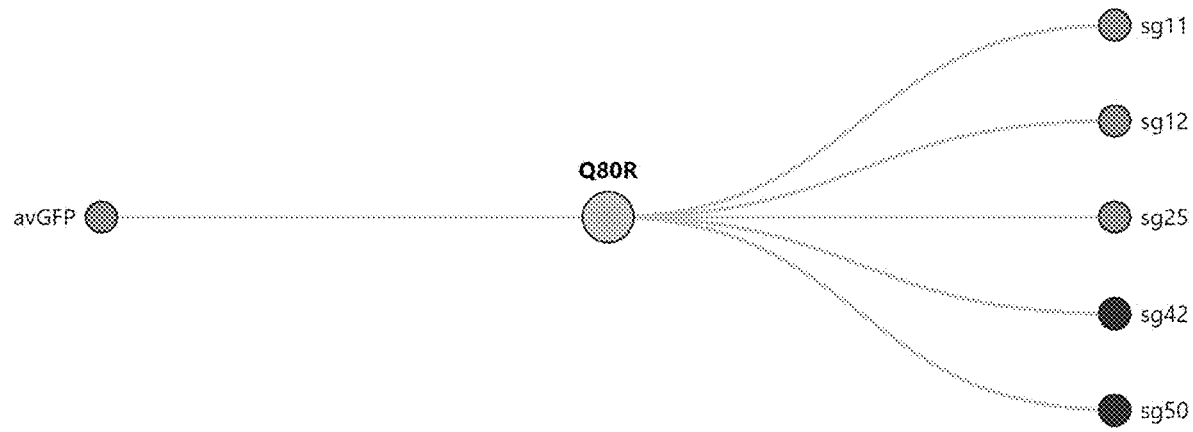
FIG. 6A(6)
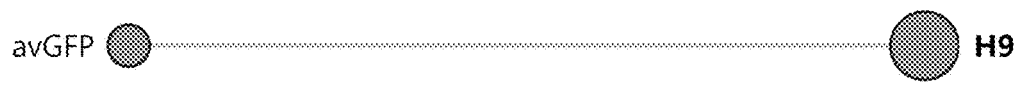
FIG. 6A(7)
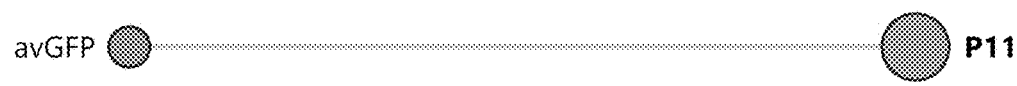
FIG. 6A(8)
FIG. 6A(9)
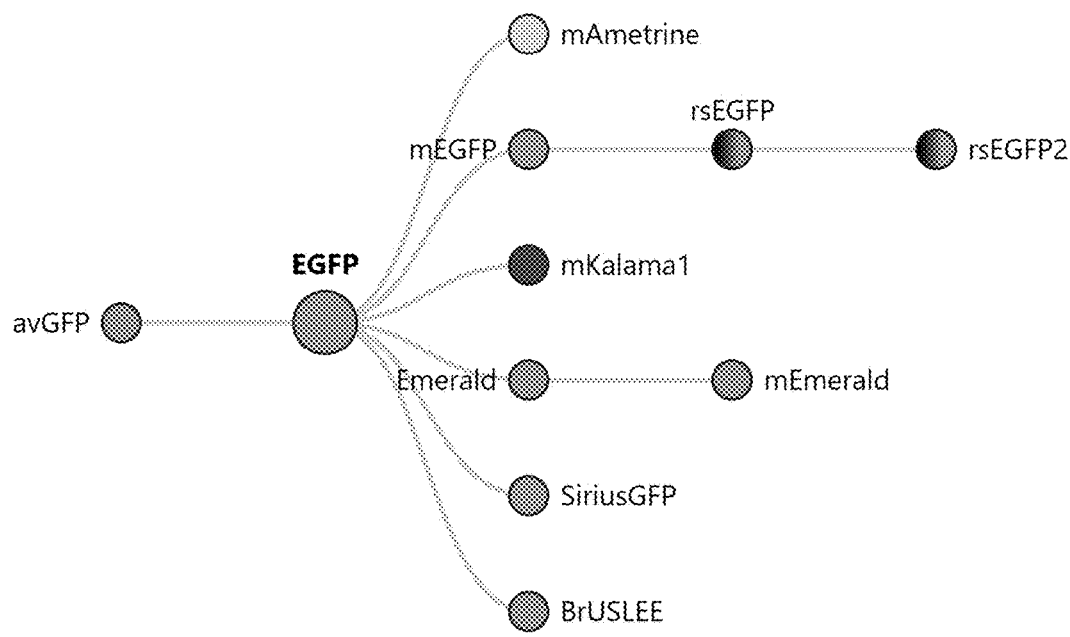
FIG. 6A(10)

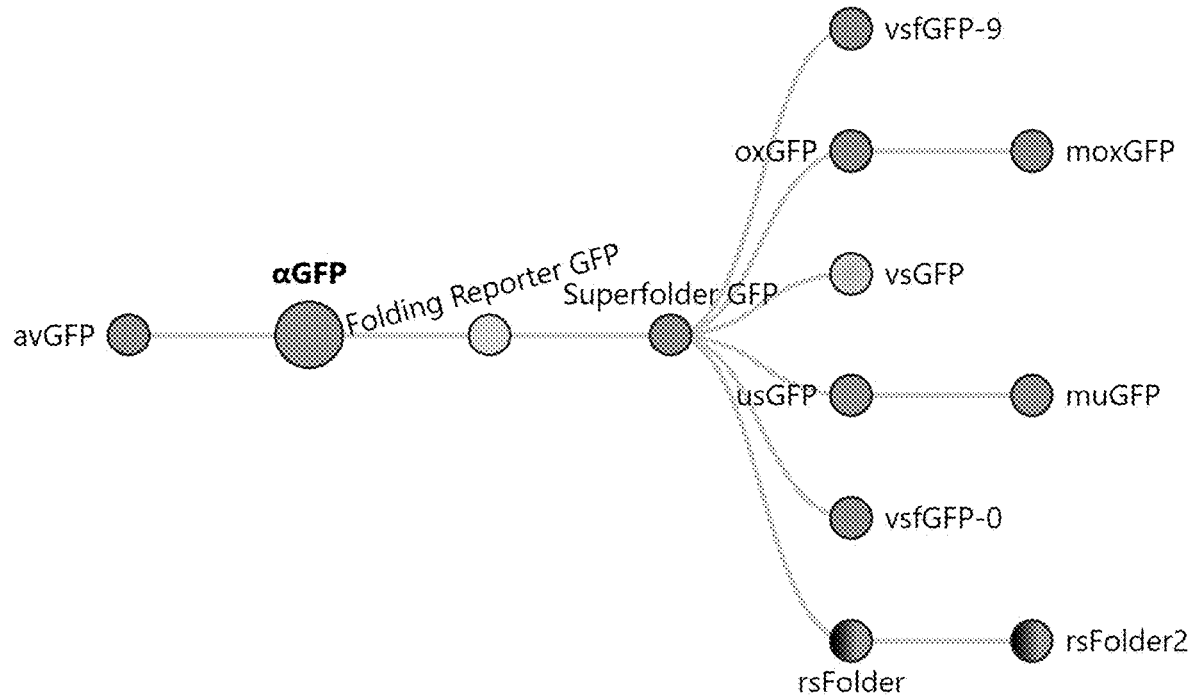
FIG. 6A(11)
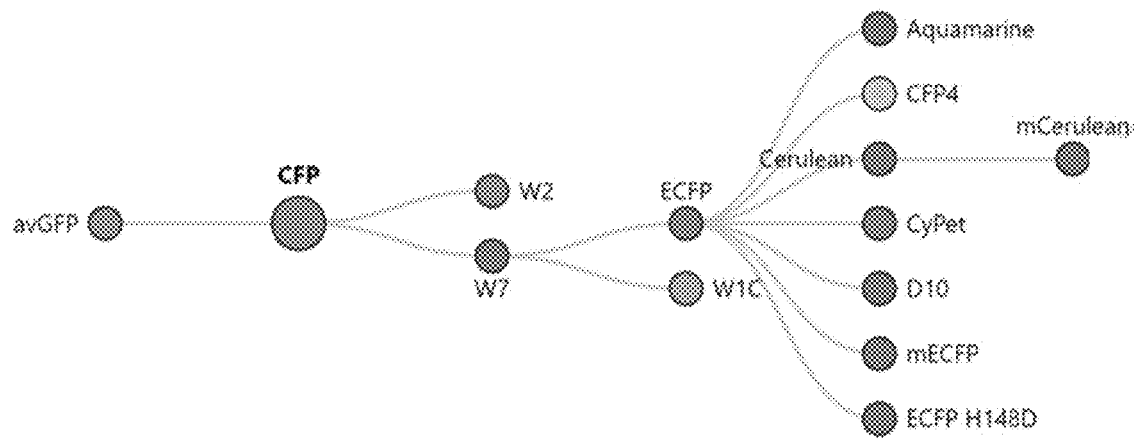
FIG. 6A(12)

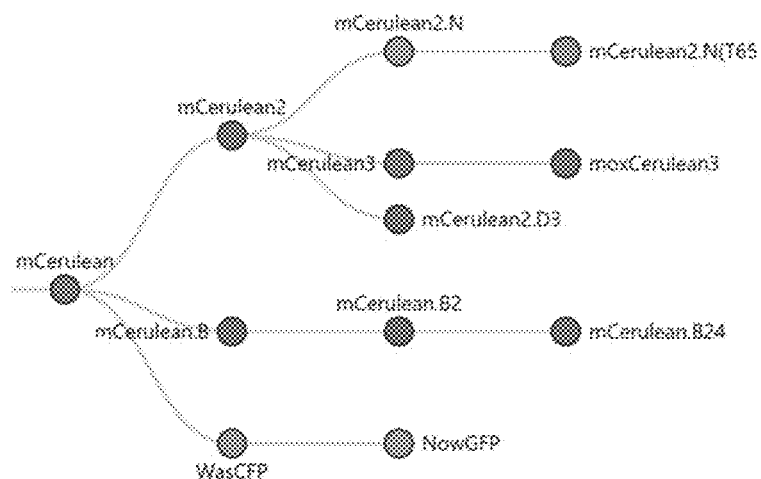
FIG. 6A(13)
FIG. 6A(14)
FIG. 6A(15)
FIG. 6A(16)
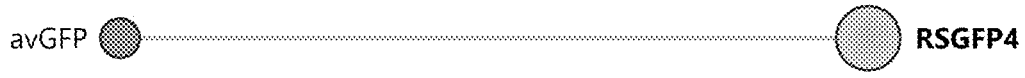
FIG. 6A(17)
FIG. 6A(18)
FIG. 6A(19)
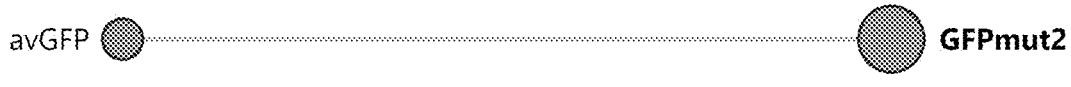
FIG. 6A(20)

FIG. 6A(21)
FIG. 6A(22)
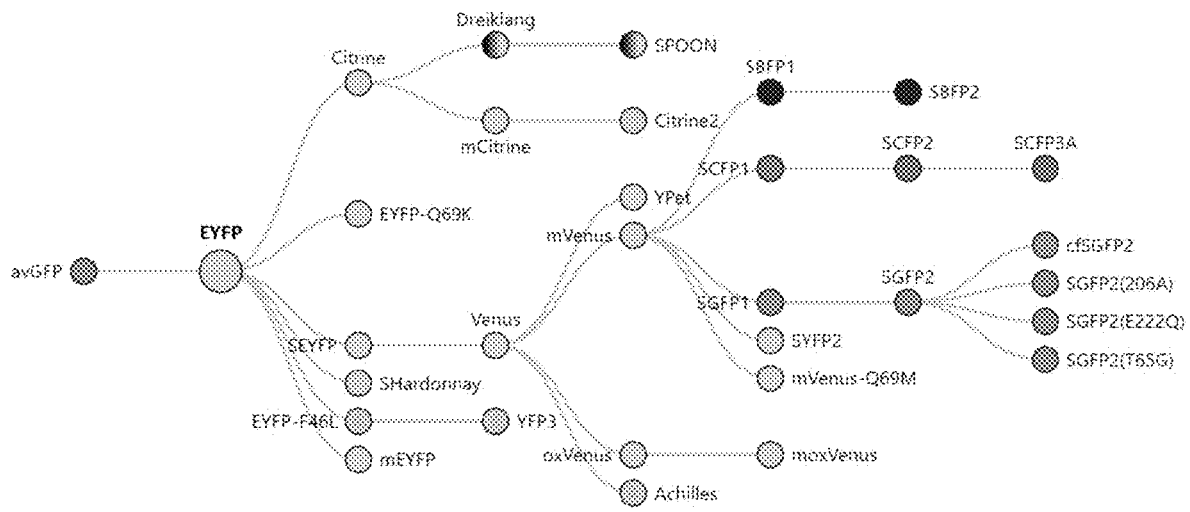
FIG. 6A(23)
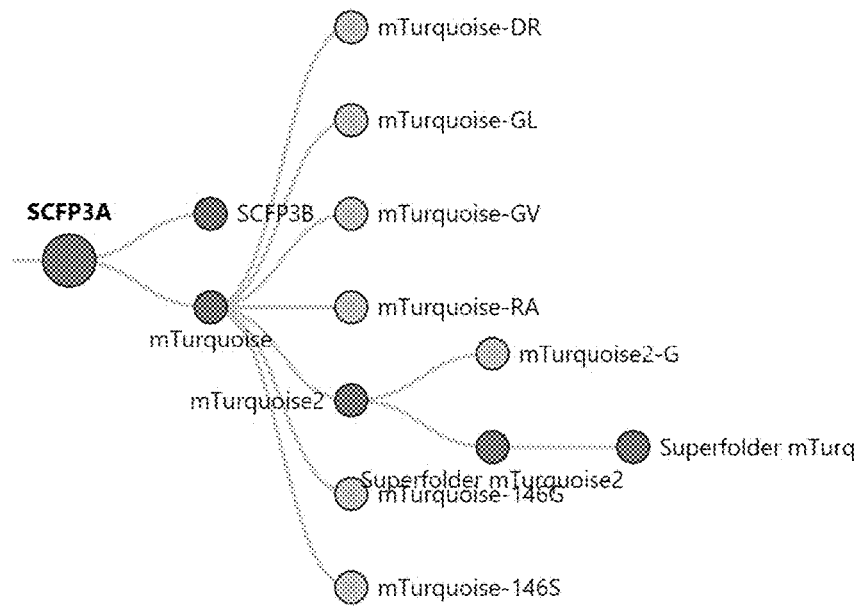
FIG. 6A(24)

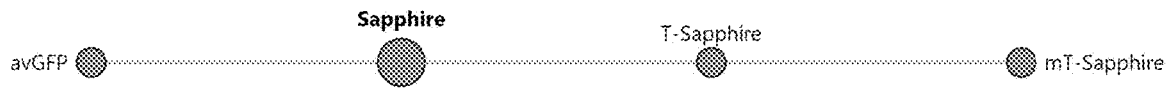
FIG. 6A(25)
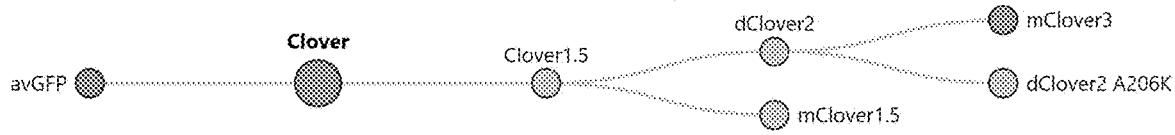
FIG. 6A(26)
FIG. 6A(27)
FIG. 6A(28)
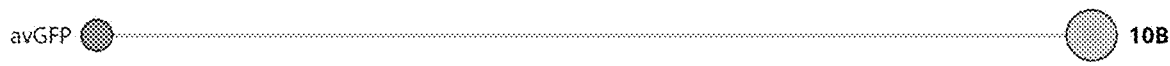
FIG. 6A(29)
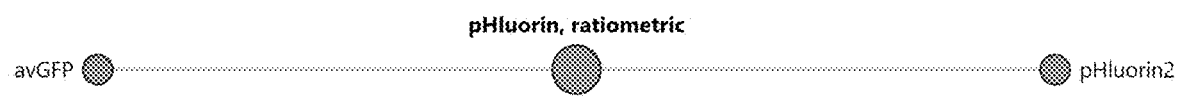
FIG. 6A(30)
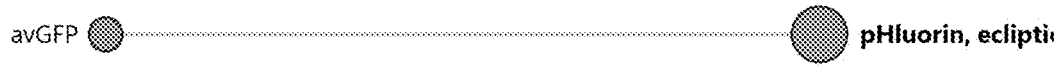
FIG. 6A(31)
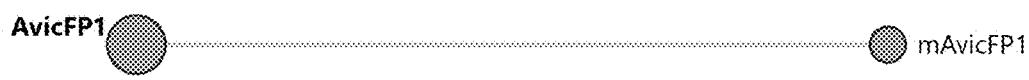
FIG. 6A(32)
FIG. 6A(33)

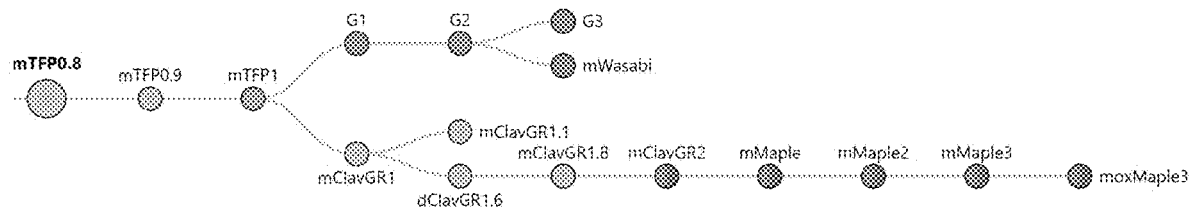
FIG. 6A(34)
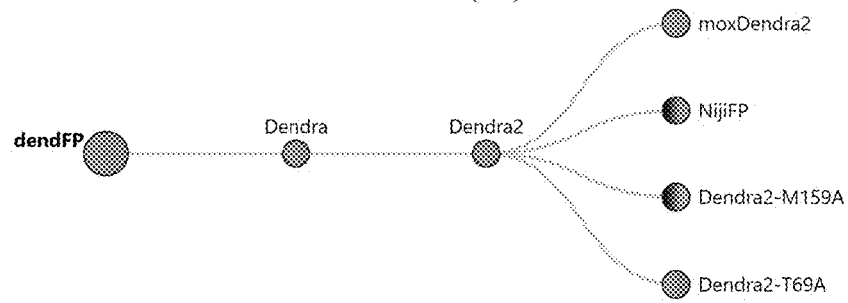
FIG. 6A(35)
FIG. 6A(36)
FIG. 6A(37)
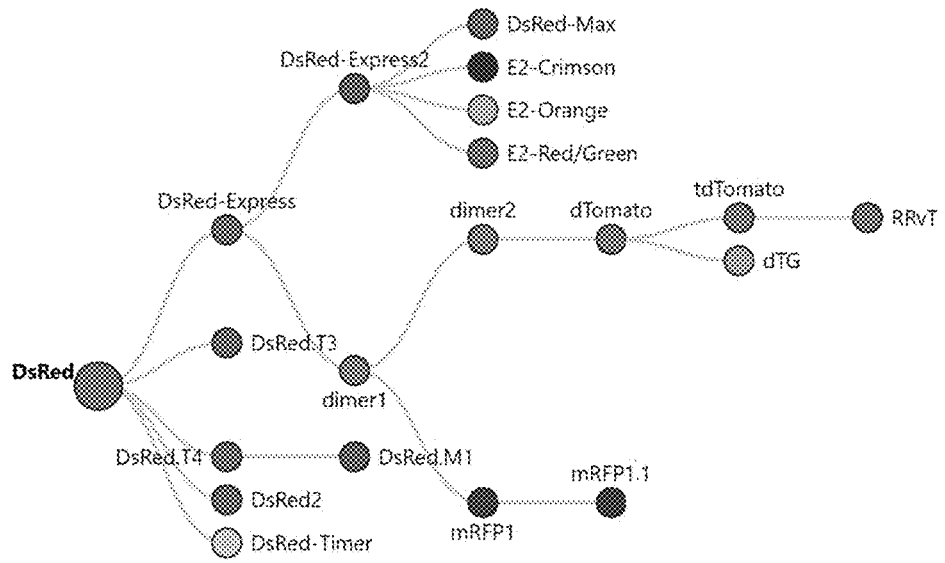
FIG. 6A(38)

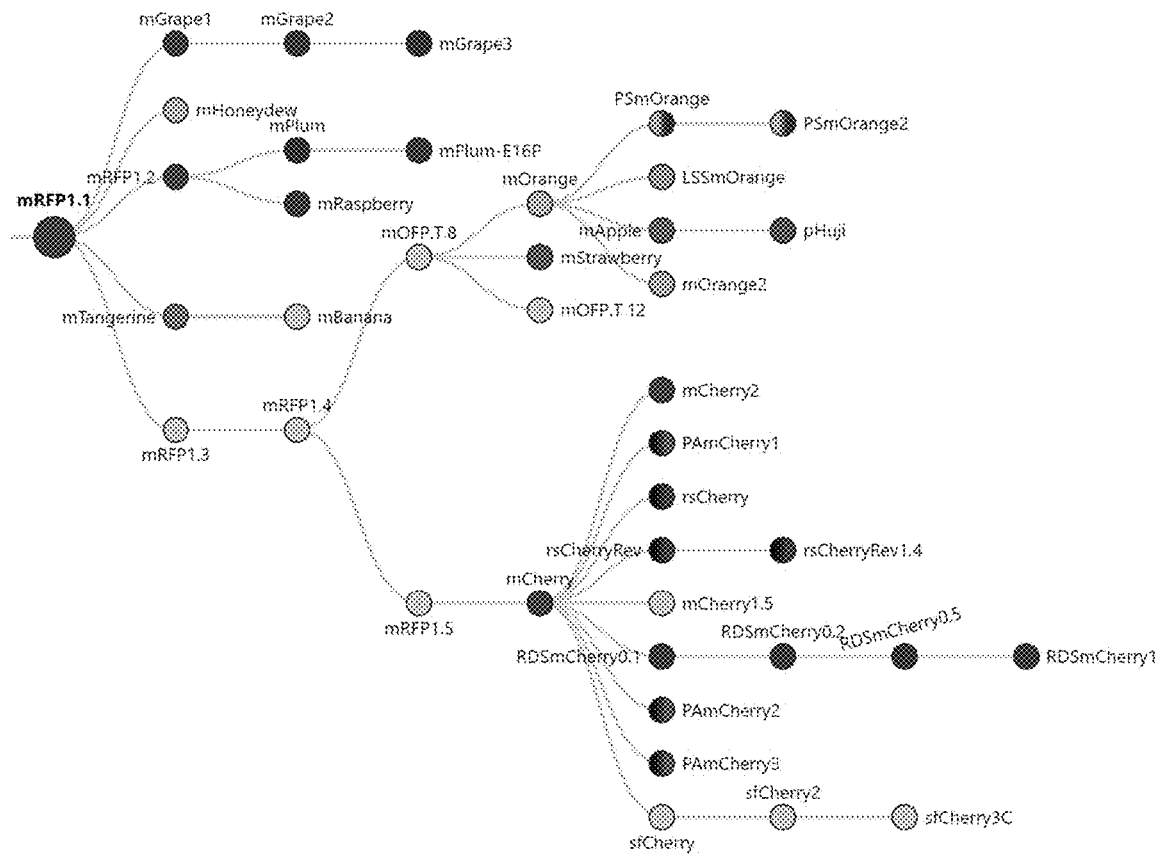
FIG. 6A(39)
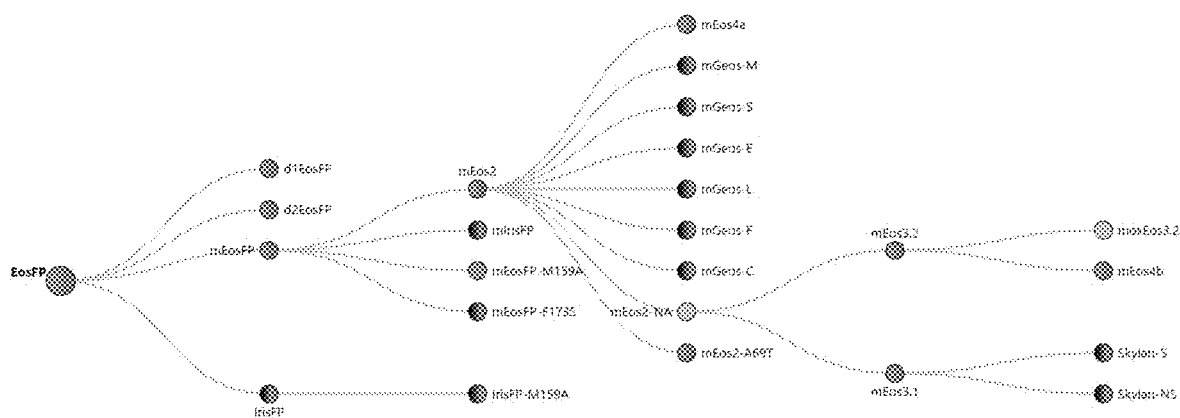
FIG. 6A(40)

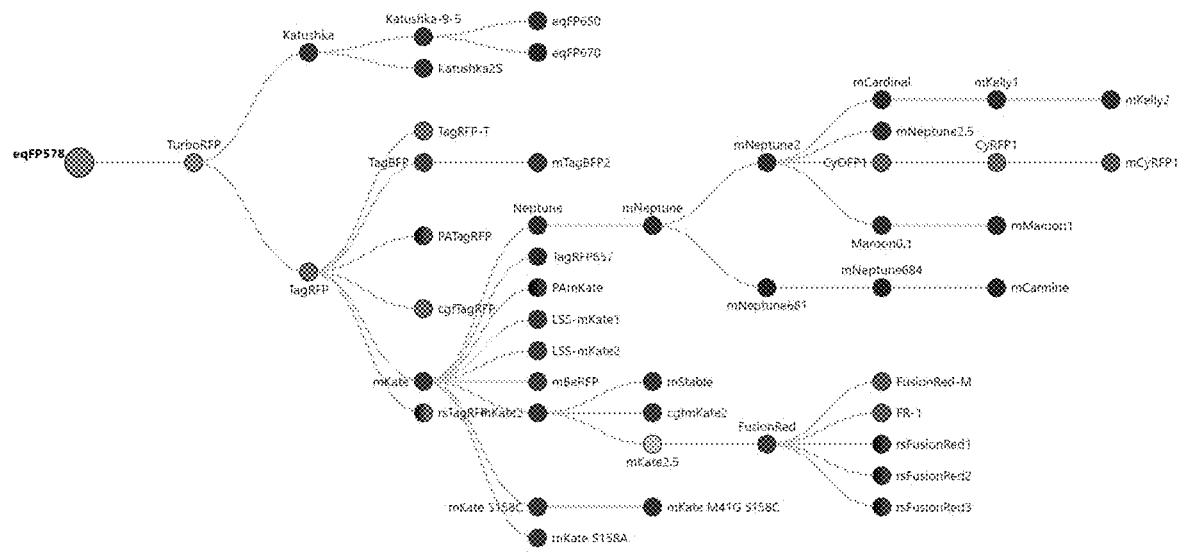
FIG. 6A(41)
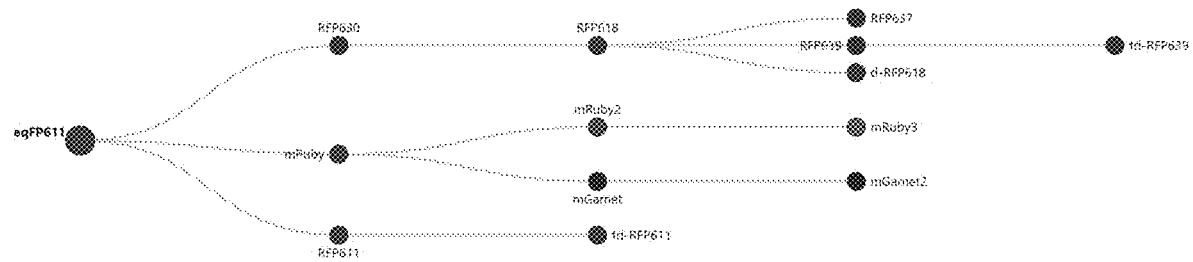
FIG. 6A(42)
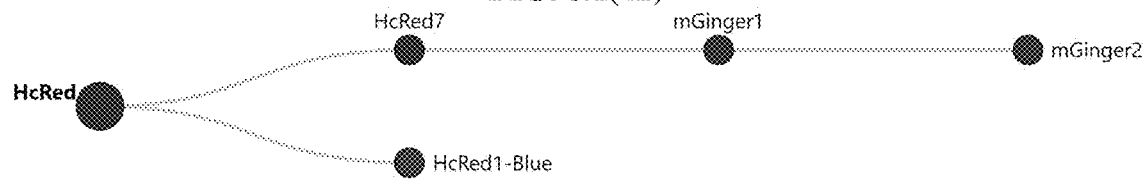
FIG. 6A(43)
FIG. 6A(44)

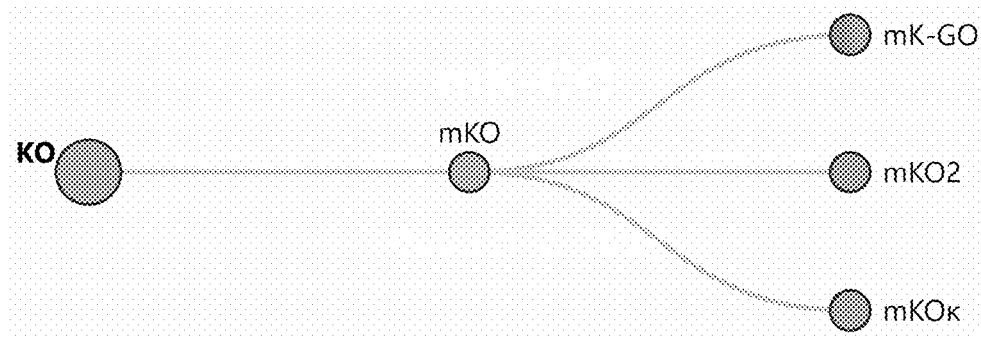
FIG. 6A(45)
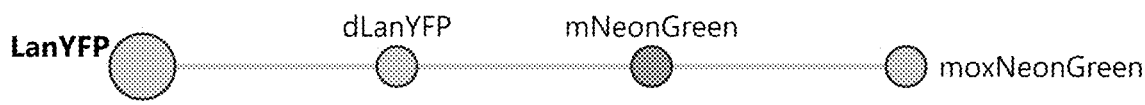
FIG. 6A(46)
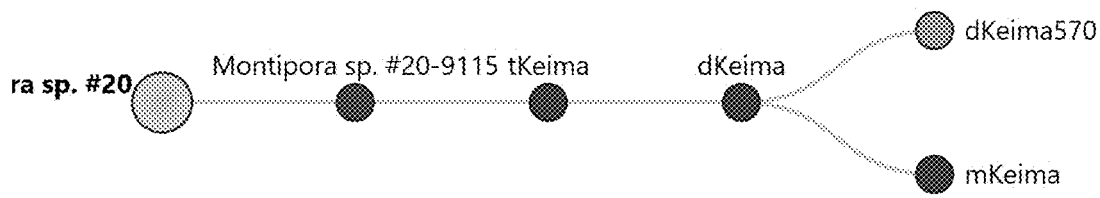
FIG. 6A(47)
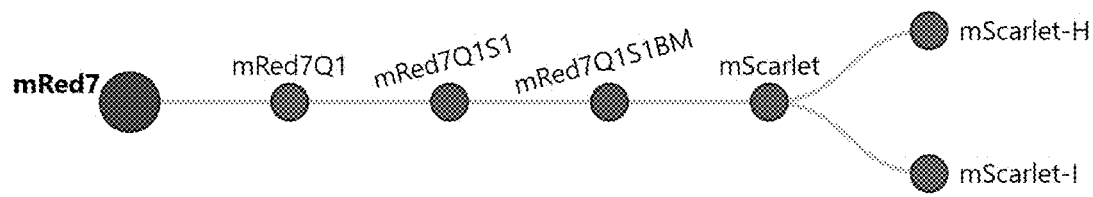
FIG. 6A(48)
FIG. 6A(49)
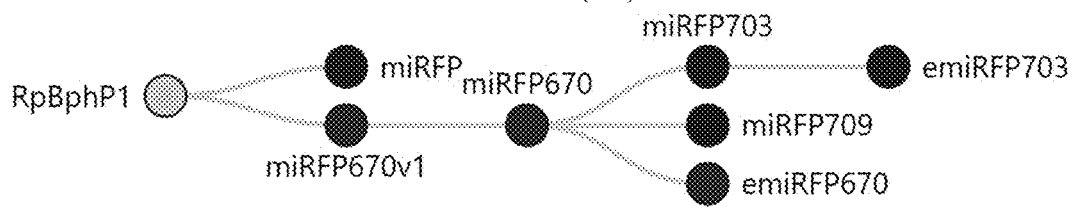
FIG. 6A(50)

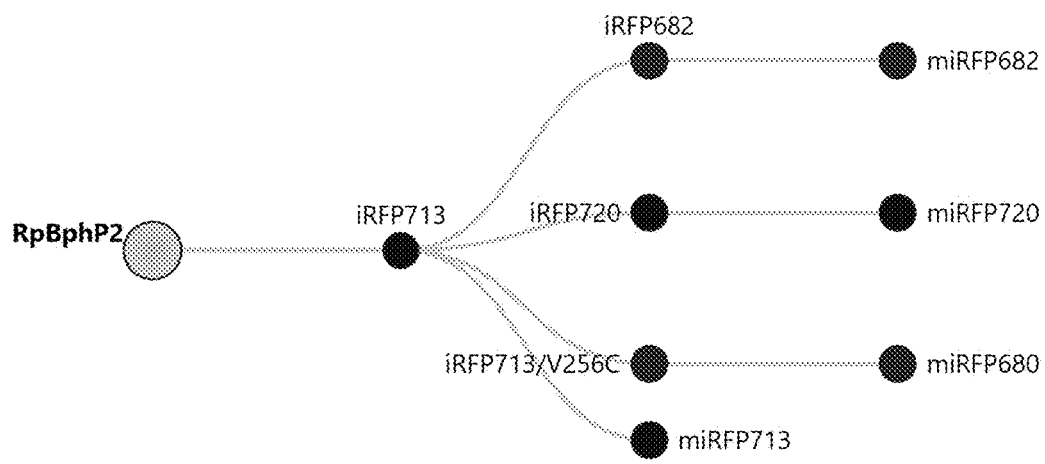
FIG. 6A(51)
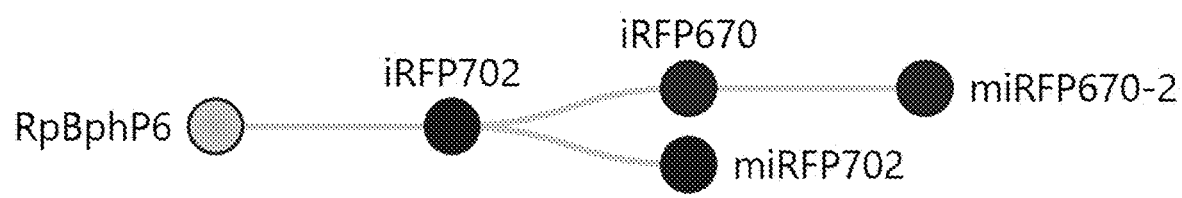
FIG. 6A(52)
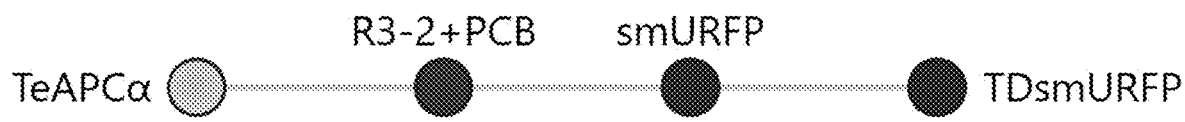
FIG. 6A(53)
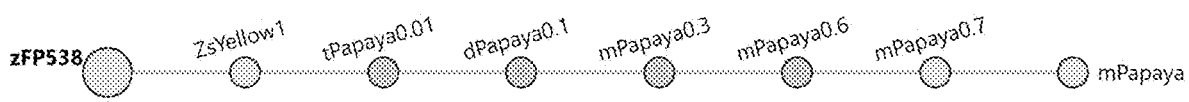
FIG. 6A(54)

SEQ ID NO: 34
>Sirius
MVSKGEELFT GVVPILVELD GDVNGHRFSV SGEGEGDATY GKLTLKLICT TGKLPVPWPT LVTTLQFGVL
CFARYPDHMK QHDFFKSAMP EGYVQERTIF FKDDGNYKTR AEVKFEGDTL VNRIELKGID FKEDGNILGH
KLEYNGISSN VYITADKQKN GIKAHFKIRH NIEDGGVQLA DHYQQNTPIG DGPVLLPDNH YLSVQSKLSK
DPNEKRDHMV LLESVTAAGI TLGMDELYK

FIG. 7A(1)

SEQ ID NO: 35
>Azurite
MSKGEELFTG VVPILVELDG DVNGHKFSVS GEGEGDATYG KLTLKFICTT GKLPVPWPTL VTTLSHGVQC
FSRYPDHMKQ HDFFKSAMPE GYVQERTIFF KDDGNYKTRA EVKFEGDTLV NRIELKGIDF KEDGNILGHK
LEYNFNSHNI YIMADKQKNG IKVNFKIRHN IEDGSVQLAD HYQQNTPIGD GPVLLPDNHY LSTQSALSKD
PNEKRDHMVL LEFRTAAGIT HGMDELYK

FIG. 7A(2)

SEQ ID NO: 36
>EBFP
MVSKGEELFT GVVPILVELD GDVNGHKFSV SGEGEGDATY GKLTLKFICT TGKLPVPWPT LVTTLTHGVQ
CFSRYPDHMK QHDFFKSAMP EGYVQERTIF FKDDGNYKTR AEVKFEGDTL VNRIELKGID FKEDGNILGH
KLEYNFNSHN VYIMADKQKN GIKVNFKIRH NIEDGSVQLA DHYQQNTPIG DGPVLLPDNH YLSTQSALSK
DPNEKRDHMV LLEFVTAAGI TLGMDELYK

FIG. 7A(3)

SEQ ID NO: 37
>EBFP2
MVSKGEELFT GVVPILVELD GDVNGHKFSV RGEGEGDATN GKLTLKFICT TGKLPVPWPT LVTTLSHGVQ
CFARYPDHMK QHDFFKSAMP EGYVQERTIF FKDDGTYKTR AEVKFEGDTL VNRIELKGVD FKEDGNILGH
KLEYNFNSHN IYIMAVKQKN GIKVNFKIRH NVEDGSVQLA DHYQQNTPIG DGPVLLPDSH YLSTQSVLSK
DPNEKRDHMV LLEFRTAAGI TLGMDELYK

FIG. 7A(4)

SEQ ID NO: 38
>ECFP
MVSKGEELFT GVVPILVELD GDVNGHKFSV SGEGEGDATY GKLTLKFICT TGKLPVPWPT LVTTLTWGVQ
CFSRYPDHMK QHDFFKSAMP EGYVQERTIF FKDDGNYKTR AEVKFEGDTL VNRIELKGID FKEDGNILGH
KLEYNYISHN VYITADKQKN GIKANFKIRH NIEDGSVQLA DHYQQNTPIG DGPVLLPDNH YLSTQSALSK
DPNEKRDHMV LLEFVTAAGI TLGMDELYK

FIG. 7A(5)

SEQ ID NO: 39

>Cerulean
MVSKGEELFT GVVPILVELD GDVNGHKFSV SGEGEGDATY GKLTLKFICT TGKLPVPWPT LVTTLTWGVQ
CFARYPDHMK QHDFFKSAMP EGYVQERTIF FKDDGNYKTR AEVKFEGDTL VNRIELKGID FKEDGNILGH
KLEYNAISDN VYITADKQKN GIKANFKIRH NIEDGSVQLA DHYQQNTPIG DGPVLLPDNH YLSTQSALSK
DPNEKRDHMV LLEFVTAAGI TLGMDELYK

FIG. 7A(6)

SEQ ID NO: 40
>CyPet
MVSKGEELFG GIVPILVELE GDVNGHKFSV SGEGEGDATY GKLTLKFICT TGKLPVPWPT LVTTLTWGVQ
CFSRYPDHMK QHDFFKSVMP EGYVQERTIF FKDDGNYKTR AEVKFEGDTL VNRIELKGID FKEDGNILGH
KLEYNYISHN VYITADKQKN GIKANFKARH NITDGSVQLA DHYQQNTPIG DGPVILPDNH YLSTQSALSK
DPNEKRDHMV LLEFVTAAGI THGMDELYK

FIG. 7A(7)

SEQ ID NO: 41
>SCFP1
MVSKGEELFT GVVPILVELD GDVNGHKFSV SGEGEGDATY GKLTLKFICT TGKLPVPWPT LVTTLTWGLQ
CFARYPDHMK QHDFFKSAMP EGYVQERTIF FKDDGNYKTR AEVKFEGDTL VNRIELKGID FKEDGNILGH
KLEYNYISHN VYITADKQKN GIKANFKIRH NIEDGGVQLA DHYQQNTPIG DGPVLLPDNH YLSTQSKLSK
DPNEKRDHMV LLEFVTAAGI TLGMDELYK

FIG. 7A(8)

SEQ ID NO: 42
>EGFP
MVSKGEELFT GVVPILVELD GDVNGHKFSV SGEGEGDATY GKLTLKFICT TGKLPVPWPT LVTTLTYGVQ
CFSRYPDHMK QHDFFKSAMP EGYVQERTIF FKDDGNYKTR AEVKFEGDTL VNRIELKGID FKEDGNILGH
KLEYNYNSHN VYIMADKQKN GIKVNFKIRH NIEDGSVQLA DHYQQNTPIG DGPVLLPDNH YLSTQSALSK
DPNEKRDHMV LLEFVTAAGI TLGMDELYK

FIG. 7A(9)

SEQ ID NO: 43
>Emerald
MVSKGEELFT GVVPILVELD GDVNGHKFSV SGEGEGDATY GKLTLKFICT TGKLPVPWPT LVTTLTYGVQ
CFARYPDHMK QHDFFKSAMP EGYVQERTIF FKDDGNYKTR AEVKFEGDTL VNRIELKGID FKEDGNILGH
KLEYNYNSHK VYITADKQKN GIKVNFKTRH NIEDGSVQLA DHYQQNTPIG DGPVLLPDNH YLSTQSALSK
DPNEKRDHMV LLEFVTAAGI TLGMDELYK

FIG. 7A(10)

SEQ ID NO: 44
>Superfolder GFP
MSKGEELFTG VVPILVELDG DVNGHKFSVR GEGEGDATNG KLTLKFICTT GKLPVPWPTL VTTLTYGVQC
FSRYPDHMKR HDFFKSAMPE GYVQERTISF KDDGTYKTRA EVKFEGDTLV NRIELKGIDF KEDGNILGHK
LEYNFNSHNV YITADKQKNG IKANFKIRHN VEDGSVQLAD HYQQNTPIGD GPVLLPDNHY LSTQSVLSKD
PNEKRDHMVL LEFVTAAGIT HGMDELYK

FIG. 7A(11)

SEQ ID NO: 45
>T-Sapphire
MVSKGEELFT GVVPILVELD GDVNGHKFSV SGEGEGDATY GKLTLKFICT TGKLPVPWPT LVTTFSYGVM
VFARYPDHMK QHDFFKSAMP EGYVQERTIF FKDDGNYKTR AEVKFEGDTL VNRIELKGID FKEDGNILGH
KLEYNFNSHN VYIMADKQKN GIKANFKIRH NIEDGGVQLA DHYQQNTPIG DGPVLLPDNH YLSIQSALSK
DPNEKRDHMV LLEFVTAAGI TLGMDELYK

FIG. 7A(12)

SEQ ID NO: 46
>EYFP
MVSKGEELFT GVVPILVELD GDVNGHKFSV SGEGEGDATY GKLTLKFICT TGKLPVPWPT LVTTFGYGLQ
CFARYPDHMK QHDFFKSAMP EGYVQERTIF FKDDGNYKTR AEVKFEGDTL VNRIELKGID FKEDGNILGH
KLEYNYNSHN VYIMADKQKN GIKVNFKIRH NIEDGSVQLA DHYQQNTPIG DGPVLLPDNH YLSYQSALSK
DPNEKRDHMV LLEFVTAAGI TLGMDELYK

FIG. 7A(13)

SEQ ID NO: 47
>Topaz
MSKGEELFTG VVPILVELDG DVNGHKFSVS GEGEGDATYG KLTLKFICTT GKLPVPWPTL VTTFGYGVQC
FARYPDHMRR HDFFKSAMPE GYVQERTIFF KDDGNYKTRA EVKFEGDTLV NRIELKGIDF KEDGNILGHK
LEYNYNSHNV YIMADKQKNG IKVNFKIRHN IEDGSVQLAD HYQQNTPIGD GPVLLPDNHY LSYQSALSKD
PNEKRDHMVL LEFVTAAGIT LGMDELYK

FIG. 7A(14)

SEQ ID NO: 48
>Venus
MVSKGEELFT GVVPILVELD GDVNGHKFSV SGEGEGDATY GKLTLKLICT TGKLPVPWPT LVTTLGYGLQ
CFARYPDHMK QHDFFKSAMP EGYVQERTIF FKDDGNYKTR AEVKFEGDTL VNRIELKGID FKEDGNILGH
KLEYNYNSHN VYITADKQKN GIKANFKIRH NIEDGGVQLA DHYQQNTPIG DGPVLLPDNH YLSYQSALSK
DPNEKRDHMV LLEFVTAAGI TLGMDELYK

FIG. 7A(15)

SEQ ID NO: 49
>YPet
MVSKGEELFT GVVPILVELD GDVNGHKFSV SGEGEGDATY GKLTLKLLCT TGKLPVPWPT LVTTLGYGVQ
CFARYPDHMK QHDFFKSAMP EGYVQERTIF FKDDGNYKTR AEVKFEGDTL VNRIELKGID FKEDGNILGH
KLEYNYNSHN VYITADKQKN GIKANFKIRH NIEDGGVQLA DHYQQNTPIG DGPVLLPDNH YLSYQSALFK
DPNEKRDHMV LLEFLTAAGI TEGMNELYK

FIG. 7A(16)

SEQ ID NO: 50
>SYFP2
MVSKGEELFT GVVPILVELD GDVNGHKFSV SGEGEGDATY GKLTLKLICT TGKLPVPWPT LVTTLGYGVQ
CFARYPDHMK QHDFFKSAMP EGYVQERTIF FKDDGNYKTR AEVKFEGDTL VNRIELKGID FKEDGNILGH
KLEYNYNSHN VYITADKQKN GIKANFKIRH NIEDGGVQLA DHYQQNTPIG DGPVLLPDNH YLSYQSKLSK
DPNEKRDHMV LLEFVTAAGI TLGMDELYK

FIG. 7A(17)

SEQ ID NO: 51
>mAmetrine
MVSKGEELFT GVVPILVELD GDVNGHKFSV RGEGEGDATN GKLTLKFICT SGKLPVPWPT LVTTLSYGVQ
CFARYPDHMK QHDFFKSAMP EGYVQERTIS FKDDGSYRTR AEVKFEGDTL VNRIELKGID FKEDGNILGH
KLEYNMNVWD AYITADKQKN GIKANFKIEH NVEDGGVQLA DAYQQNTPIG DGSVLLPDNH YLSFQSKLFK
DPNEQRDHMV LLEFVTAAGI TPGMDELYK

FIG. 7A(18)

SEQ ID NO: 52
>mTagBFP
MSELIKENMH MKLYMEGTVD NHHFKCTSEG EGKPYEGTQT MRIKVVEGGP LPFAFDILAT SFLYGSKTFI
NHTQGIPDFF KQSFPEGFTW ERVTTYEDGG VLTATQDTSL QDGCLIYNVK IRGVNFTSNG PVMQKKTLGW
EAFTETLYPA DGGLEGRNDM ALKLVGGSHL IANIKTTYRS KKPAKNLKMP GVYYVDYRLE RIKEANNETY
VEQHEVAVAR YCDLPSKLGH KLN

FIG. 7A(19)

SEQ ID NO: 53
>TagCFP
MSGGEELFAG IVPVLIELDG DVHGHKFSVR GEGEGDADYG KLEIKFICTT GKLPVPWPTL VTTLAWGIQC
FARYPEHMKM NDFFKSAMPE GYIQERTIHF QDDGKYKTRG EVKFEGDTLV NRVELKGEGF KEDGNILGHK
LEYSAISDNV YIMPDKANNG LEANFKIRHN IEGGGVQLAD HYQTNVPLGD GPVLIPINHY LSCQSAISKD
RNEARDHMVL LESFSAYCHT HGMDELYR

FIG. 7A(20)

SEQ ID NO: 54
>AmCyan
MALSNKFIGD DMKMTYHMDG CVNGHYFTVK GEGSGKPYEG TQTSTFKVTM ANGGPLAFSF DILSTVFMYG
NRCFTAYPTS MPDYFKQAFP DGMSYERTFT YEDGGVATAS WEISLKGNCF EHKSTFHGVN FPADGPVMAK
MTTGWDPSFE KMTVCDGILK GDVTAFLMLQ GGGNYRCQFH TSYKTKKPVT MPPNHAVEHR IARTDLDKGG
NSVQLTEHAV AHITSVVPF

FIG. 7A(21)

SEQ ID NO: 55
>Midoriishi Cyan
MVSYSKQGIA QEMRTKYRME GSVNGHEFTI EGVGTGNPYE GKQMSELVII KSKGKPLPFS FDILSTAFQY
GNRCFTKYPA DMPDYFKQAF PDGMSYERSF LFEDGGVATA SWSIRLEGNC FIHNSIYHGV NFPADGPVMK
KQTIGWDKSF EKMSVAKEVL RGDVTQFLLL EGGGYQRCRF HSTYKTEKPV AMPPSHVVEH QIVRTDLGQT
AKGFKVKLEE HAEAHVNPLK VK

FIG. 7A(22)

SEQ ID NO: 56
>mTFP1
MVSKGEETTM GVIKPDMKIK LKMEGNVNGH AFVIEGEGEG KPYDGTNTIN LEVKEGAPLP FSYDILTTAF
AYGNRAFTKY PDDIPNYFKQ SFPEGYSWER TMTFEDKGIV KVKSDISMEE DSFIYEIHLK GENFPPNGPV
MQKKTTGWDA STERMYVRDG VLKGDVKHKL LEEGGHHRV DFKTIYRAKK AVKLPDYHFV DHRIEILNHD
KDYNKVTVYE SAVARNSTDG MDELYK

FIG. 7A(23)

SEQ ID NO: 57
>Azami Green
MSVIKPEMKI KLCMRGTVNG HNFVIEGEGK GNPYEGTQIL DLNVTEGAPL PFAYDILTTV FQYGNRAFTK
YPADIQDYFK QTFPEGYHWE RSMTYEDQGI CTATSNISMR GDCFFYDIRF DGVNFPPNGP VMQKKTLKWE
PSTEKMYVRD GVLKGDVNMA LLLEGGGHYR CDFKTTYKAK KDVRLPDYHF VDHRIEILKH DKDYNKVKLY
ENAVARYSML PSQAK

FIG. 7A(24)

SEQ ID NO: 58

>mWasabi
MVSKGEETTM GVIKPDMKIK LKMEGNVNGH AFVIEGEGEG KPYDGTNTIN LEVKEGAPLP FSYDILTTAF
SYGNRAFTKY PDDIPNYFKQ SFPEGYSWER TMTFEDKGIV KVKSDISMEE DSFIYEIHLK GENFPPNGPV
MQKETTGWDA STERMYVRDG VLKGDVKMKL LLEGGGHHRV DFKTIYRAKK AVKLPDYHFV DHRIEILNHD
KDYNKVTVYE IAVARNSTDG MDELYK

FIG. 7A(25)

SEQ ID NO: 59
>ZsGreen
MAQSKHGLTK EMTMKYRMEG CVDGHKFVIT GEGIGYPFKG KQAINLCVVE GGPLPFAEDI LSAAFNYGNR
VFTEYPQDIV DYFKNSCPAG YTWDRSFLFE DGAVCICNAD ITVSVEENCM YHESKFYGVN FPADGPVMKK
MTDNWEPSCE KIIPVPKQGI LKGDVSMYLL LKDGGRLRCQ FDTVYKAKSV PRKMPDWHFI QHKLTREDRS
DAKNQKWHLT EHAIASGSAL P

FIG. 7A(26)

SEQ ID NO: 60
>TagGFP
MSGGEELFAG VVPILVELDG DVNGHKFSVS GEGEGDATYG KLTLKFICTT GKLPVPWPTL VTTLCYGVQC
FSRYPDHMKQ HDFFKSAMPE GYVQERTILF KDDGNYKTRA EVKFEGDTLV NRIELKGKDF KEDGNILGHK
LEYSYNSHNV YIMADKQKNG IEVNFKTRHN IEDGSVQLAD HYQQNTPIGD GPVLLPDNHY LSTQSALSKD
PNEARDHMVL LELSTAACIT HGMDELYR

FIG. 7A(27)

SEQ ID NO: 61
>TagGFP2
MSGGEELFAG IVPVLIELDG DVHGHKFSVR GEGEGDADYG KLEIKFICTT GKLPVPWPTL VTTLCYGIQC
FARYPEHMKM NDFFKSAMPE GYIQERTIQF QDDGKYKTRG EVKFEGDTLV NRIELKGKDF KEDGNILGHK
LEYSFNSHNV YIRPDKANNG LEANFKTRHN IEGGGVQLAD HYQTNVPLGD GPVLIPINHY LSTQTKISKD
RNEARDHMVL LESFSACCHT HGMDELYR

FIG. 7A(28)

SEQ ID NO: 62
>TurboGFP
MESDESGLPA MEIECRITGT LNGVEFELVG GGEGTPEQGR MTNKMKSTKG ALTFSPYLLS HVMGYGFYHF
GTYPSGYENP FLHAINNGGY TNTRIEKYED GGVLHVSFSY RYEAGRVIGD FKVMGTGFPE DSVIFTDKII
RSNATVEHLH PMGDNDLDGS FTRTFSLRDG GYYSSVVDSH MHFKSAIHPS ILQNGGPMFA FRRVEEDHSN
TELGIVEYQH AFKTPDADAG EE

FIG. 7A(29)

SEQ ID NO: 63
>CopGFP
MPAMKIECRI TGTLNGVEFE LVGGGEGTPE QGRMTNKMKS TKGALTFSPY LLSHVMGYGF YHFGTYPSGY
ENPFLHAINN GGYTNTRIEK YEDGGVLHVS FSYRYEAGRV IGDFKVVGTG FPEDSVIFTD KIIRSNATVE
HLHPMGDNVL VGSFARTFSL RDGGYYSFVV DSHMHFKSAI HPSILQNGGP MFAFRRVEEL HSNTELGIVE
YQHAFKTPIA FA

FIG. 7A(30)

SEQ ID NO: 64
>AceGFP
MSKGAELFTG IVPILIELNG DVNGHKFSVS GEGEGDATYG KLTLKFICTT GKLPVPWPTL VTTLSYGVQC
FSRYPDHMKQ HDFFKSAMPE GYIQERTIFF EDDGNYKSRA EVKFEGDTLV NRIELTGTDF KEDGNILGNK
MEYNYNAHNV YIMTDKAKNG IKVNFKIRHN IEDGSVQLAD HYQQNTPIGD GPVLLPDNHY LSTQSALSKD
PNEKRDHMIY FGFVTAAAIT HGMDELYK

FIG. 7A(31)

SEQ ID NO: 65
>TagYFP
MVSKGEELFA GIVPVLIELD GDVHGHKFSV RGEGEGDADY GKLEIKFICT TGKLPVPWPT LVTTLTYGVQ
CFARYPKHMK MNDFFKSAMP EGYIQERTIL FQDDGKYKTR GEVKFEGDTL VNRIELKGKD FKEDGNILGH
KLEYSFNSHN VYITPDKANN GLEVNFKTRH NIEGGGVQLA DHYQTNVPLG DGPVLIPINH YLSYQTDISK
DRNEARDHMV LLESVSACSH THGMDELYR

FIG. 7A(32)

SEQ ID NO: 66
>ZsYellow1
MAHSKHGLKE EMTMKYHMEG CVNGHKFVIT GEGIGYPFKG KQTINLCVIE GGPLPFSEDI LSAGFKYGDR
IFTEYPQDIV DYFKNSCPAG YTWGRSFLFE DGAVCICNVD ITVSVKENCI YHKSIFNGVN FPADGPVMKK
MTTNWEASCE KIMPVPKQGI LKGDVSMYLL LKDGGRYRCQ FDTVYKAKSV PSKMPEWHFI QHKLLREDRS
DAKNQKWQLT EHAIAFPSAL A

FIG. 7A(33)

SEQ ID NO: 67
>PhiYFP
MSSGALLFHG KIPYVVEMEG NVDGHTFSIR GKGYGDASVG KVDAQFICTT GDVPVPWSTL VTTLTYGAQC
FAKYGPELKD FYKSCMPEGY VQERTITFEG DGVFKTRAEV TFENGSVYNR VKLNGQGFKK DGHVLGKNLE
FNFTPHCLYI WGDQANHGLK SAFKIMHEIT GSKEDFIVAD HTQMNTPIGG GPVHVPEYHH ITYHVTLSKD
VTDHRDNMSL VETVRAVDCR KTYL

FIG. 7A(34)

SEQ ID NO: 68
>Kusabira Orange
MSVIKPEMKM KYFMDGSVNG HEFTVEGEGT GKPYEGHQEM TLRVTMAKGG PMPFSFDLVS HTFCYGHRPF
TKYPEEIPDY FKQAFPEGLS WERSLQFEDG GFAAVSAHIS LRGNCFEHKS KFVGVNFPAD GPVMQNQSSD
WEPSTEKITT CDGVLKGDVT MFLKLAGGGN HKCQFKTTYK AAKKILKMPQ SHFIGHRLVR KTEGNITELV
EDAVAHC

FIG. 7A(35)

SEQ ID NO: 69
>Kusabira Orange 2
MVSVIKPEMK MRYYMDGSVN GHEFTIEGEG TGRPYEGHQE MTLRVTMAEG GPMPFAFDLV SHVFCYGHRV
FTKYPEEIPD YFKQAFPEGL SWERSLEFED GGSASVSAHI SLRGNTFYHK SKFTGVNFPA DGPIMQNQSV
DWEPSTEKIT ASDGVLKGDV TMYLKLEGGG NHKCQMKTTY KAAKEILEMP GDHYIGHRLV RKTEGNITEQ
VEDAVAHS

FIG. 7A(36)

SEQ ID NO: 70
>mOrange
MVSKGEENNM AIIKEFMRFK VRMEGSVNGH EFEIEGEGEG RPYEGFQTAK LKVTKGGPLP FAWDILSPQF
TYGSKAYVKH PADIPDYFKL SFPEGFKWER VMNFEDGGVV TVTQDSSLQD GEFIYKVKLR GTNFPSDGPV
MQKKTMGWEA SSERMYPEDG ALKGEIKMRL KLKDGGHYTS EVKTTYKAKK PVQLPGAYIV GIKLDITSHN
EDYTIVEQYE RAEGRHSTGG MDELYK

FIG. 7A(37)

SEQ ID NO: 71
>mOrange2
MVSKGEENNM AIIKEFMRFK VRMEGSVNGH EFEIEGEGEG RPYEGFQTAK LKVTKGGPLP FAWDILSPHF
TYGSKAYVKH PADIPDYFKL SFPEGFKWER VMNYEDGGVV TVTQDSSLQD GEFIYKVKLR GTNFPSDGPV
MQKKTMGWEA SSERMYPEDG ALKGKIKMRL KLKDGGHYTS EVKTTYKAKK PVQLPGAYIV DIKLDITSHN
EDYTIVEQYE RAEGRHSTGG MDELYK

FIG. 7A(38)

SEQ ID NO: 72
>dTomato
MVSKGEEVIK EFMRFKVRME GSMNGHEFEI EGEGEGRPYE GTQTAKLKVT KGGPLPFAWD ILSPQFMYGS
KAYVKHPADI PDYKKLSFPE GFKWERVMNF EDGGLVTVTQ DSSLQDGTLI YKVKMRGTNF PPDGPVMQKK
TMGWEASTER LYPRDGVLKG EIHQALKLKD GGHYLVEFKT IYMAKKPVQL PGYYYVDTKL DITSHNEDYT
IVEQYERSEG RHHLFLYGMD ELYK

FIG. 7A(39)

SEQ ID NO: 73
>tdTomato
MVSKGEEVIK EFMRFKVRME GSMNGHEFEI EGEGEGRPYE GTQTAKLKVT KGGPLPFAWD ILSPQFMYGS
KAYVKHPADI PDYKKLSFPE GFKWERVMNF EDGGLVTVTQ DSSLQDGTLI YKVKMRGTNF PPDGPVMQKK
TMGWEASTER LYPRDGVLKG EIHQALKLKD GGHYLVEFKT IYMAKKPVQL PGYYYVDTKL DITSHNEDYT
IVEQYERSEG RHHLFLGHGT GSTGSGSSGT ASSEDNNMAV IKEFMRFKVR MEGSMNGHEF EIEGEGEGRP
YEGTQTAKLK VTKGGPLPFA WDILSPQFMY GSKAYVKHPA DIPDYKKLSF PEGFKWERVM NFEDGGLVTV
TQDSSLQDGT LIYKVKMRGT NFPPDGPVMQ KKTMGWEAST ERLYPRDGVL KGEIHQALKL KDGGHYLVEF
KTIYMAKKPV QLPGYYYVDT KLDITSHNED YTIVEQYERS EGRHHLFLYG MDELYK

FIG. 7A(40)

SEQ ID NO: 74
>DsRed
MRSSKNVIKE FMRFKVRMEG TVNGHEFEIE GEGEGRPYEG HNTVKLKVTK GGPLPFAWDI LSPQFQYGSK
VYVKHPADIP DYKKLSFPEG FKWERVMNFE DGGVVTVTQD SSLQDGCFIY KVKFIGVNFP SDGPVMQKKT
MGWEASTERL YPRDGVLKGE IHKALKLKDG GHYLVEFKSI YMAKKPVQLP GYYYVDSKLD ITSHNEDYTI
VEQYERTEGR HHLFL

FIG. 7A(41)

SEQ ID NO: 75
>DsRed2
MASSENVITE FMRFKVRMEG TVNGHEFEIE GEGEGRPYEG HNTVKLKVTK GGPLPFAWDI LSPQFQYGSK
VYVKHPADIP DYKKLSFPEG FKWERVMNFE DGGVATVTQD SSLQDGCFIY KVKFIGVNFP SDGPVMQKKT
MGWEASTERL YPRDGVLKGE THKALKLKDG GHYLVEFKSI YMAKKPVQLP GYYYVDAKLD ITSHNEDYTI
VEQYERTEGR HHLFL

FIG. 7A(42)

SEQ ID NO: 76
>DsRed-Express
MASSEDVIKE FMRFKVRMEG SVNGHEFEIE GEGEGRPYEG TQTAKLKVTK GGPLPFAWDI LSPQFQYGSK
VYVKHPADIP DYKKLSFPEG FKWERVMNFE DGGVVTVTQD SSLQDGSFIY KVKFIGVNFP SDGPVMQKKT
MGWEASTERL YPRDGVLKGE IHKALKLKDG GHYLVEFKSI YMAKKPVQLP GYYYVDSKLD ITSHNEDYTI
VEQYERAEGR HHLFL

FIG. 7A(43)

SEQ ID NO: 77
>DsRed-Express2
MDSTENVIKP FMRFKVHMEG SVNGHEFEIE GEGEGKPYEG TQTAKLQVTK GGPLPFAWDI LSPQFQYGSK
VYVKHPADIP DYKKLSFPEG FKWERVMNFE DGGVVTVTQD SSLQDGTFIY HVKFIGVNFP SDGPVMQKKT
LGWEPSTERL YPRDGVLKGE IHKALKLKGG GHYLVEFKSI YMAKKPVKLP GYYYVDSKLD ITSHNEDYTV
VEQYERAEAR HHLFQ

FIG. 7A(44)

SEQ ID NO: 78
>DsRed-Max
MDSTENVIKP FMRFKVHMEG SVNGHEFEIE GEGEGKPYEG TQTAKLQVTK GGPLPFAWDI LSPQFMYGSK
VYTKHPADIP DYKKLSFPEG FKWERVMNFE DGGVVTVTQD SSLQDGTFIY HVKFIGVNFP SDGPVMQKKT
LGWEPSTERL YPRDGVLKGE IHKALKLKGG GHYLCEFKSI YMAKKPVKLP GYYYVDSKLD ITSHNEDYTV
VEQYERTEAR HHLFQ

FIG. 7A(45)

SEQ ID NO: 79
>DsRed.M1
MDNTEDVIKE FMQFKVRMEG SVNGHYFEIE GEGEGKPYEG TQTAKLQVTK GGPLPFAWDI LSPQFQYGSK
AYVKHPADIP DYMKLSFPEG FTWERSMNFE DGGVVEVQQD SSLQDGTFIY KVKFKGVNFP ADGPVMQKKT
AGWEPSTEKL YPQDGVLKGE ISHALKLKDG GHYTCDFKTV YKAKKPVQLP GNHYVDSKLD ITNHNEDYTV
VEQYEHAEAR HSGSQ

FIG. 7A(46)

SEQ ID NO: 80
>TurboRFP
MSELIKENMH MKLYMEGTVN NHHFKCTSEG EGKPYEGTQT MKIKVVEGGP LPFAFDILAT SFMYGSKAFI
NHTQGIPDFF KQSFPEGFTW ERITTYEDGG VLTATQDTSF QNGCIIYNVK INGVNFPSNG PVMQKKTRGW
EANTEMLYPA DGGLRGHSQM ALKLVGGGYL HCSFKTTYRS KKPAKNLKMP GFHFVDHRLE RIKEADKETY
VEQHEMAVAK YCDLPSKLGH R

FIG. 7A(47)

SEQ ID NO: 81
>TagRFP
MSELIKENMH MKLYMEGTVN NHHFKCTSEG EGKPYEGTQT MRIKVVEGGP LPFAFDILAT SFMYGSRTFI
NHTQGIPDFF KQSFPEGFTW ERVTTYEDGG VLTATQDTSL QDGCLIYNVK IRGVNFPSNG PVMQKKTLGW
EANTEMLYPA DGGLEGRSDM ALKLVGGGHL ICNFKTTYRS KKPAKNLKMP GVYYVDHRLE RIKEADKETY
VEQHEVAVAR YCDLPSKLGH K

FIG. 7A(48)

SEQ ID NO: 82
>TagRFP-T
MVSKGEELIK ENMHMKLYME GTVNNHHFKC TSEGEGKPYE GTQTMRIKVV EGGPLPFAFD ILATSFMYGS
RTFINHTQGI PDFFKQSFPE GFTWERVTTY EDGGVLTATQ DTSLQDGCLI YNVKIRGVNF PSNGPVMQKK
TLGWEANTEM LYPADGGLEG RTDMALKLVG GGHLICNFKT TYRSKKPAKN LKMPGVYYVD HRLERIKEAD
KETYVEQHEV AVARYCDLPS KLGHKLNGMD ELYK

FIG. 7A(49)

SEQ ID NO: 83
>mRuby
MNSLIKENMR MKVVLEGSVN GHQFKCTGEG EGNPYMGTQT MRIKVIEGGP LPFAFDILAT SFMYGSRTFI
KYPKGIPDFF KQSFPEGFTW ERVTRYEDGG VITVMQDTSL EDGCLVYHAQ VRGVNFPSNG AVMQKKTKGW
EPNTEMMYPA DGGLRGYTHM ALKVDGGGHL SCSFVTTYRS KKTVGNIKMP GIHAVDHRLE RLEESDNEMF
VVQREHAVAK FAGLGGG

FIG. 7A(50)

SEQ ID NO: 84
>mApple
MVSKGEENNM AIIKEFMRFK VHMEGSVNGH EFEIEGEGEG RPYEAFQTAK LKVTKGGPLP FAWDILSPQF
MYGSKVYIKH PADIPDYFKL SFPEGFRWER VMNFEDGGII HVNQDSSLQD GVFIYKVKLR GTNFPSDGPV
MQKKTMGWEA SEERMYPEDG ALKSEIKKRL KLKDGGHYAA EVKTTYKAKK PVQLPGAYIV DIKLDIVSHN
EDYTIVEQYE RAEGRHSTGG MDELYK

FIG. 7A(51)

SEQ ID NO: 85
>mStrawberry
MVSKGEENNM AIIKEFMRFK VRMEGSVNGH EFEIEGEGEG RPYEGTQTAK LKVTKGGPLP FAWDILTPNF
TYGSKAYVKH PADIPDYLKL SFPEGFKWER VMNFEDGGVV TVTQDSSLQD GEFIYKVKLR GTNFPSDGPV
MQKKTMGWEA SSERMYPEDG ALKGEIKMRL KLKDGGHYDA EVKTTYKAKK PVQLPGAYIV GIKLDITSHN
EDYTIVELYE RAEGRHSTGG MDELYK

FIG. 7A(52)

SEQ ID NO: 86
>AsRed2
MASLLKKTMP FRTTIEGTVN GHYFKCTGKG EGNPLEGTQE MKIEVIEGGP LPFAFHILST SCMYGSKAFI
KYVSGIPDYF KQSLPEGFTW ERTTTYEDGG FLTAHQDTSL DGDCLVYKVK ILGNNFPADG PVMQNKAGRW
EPSTEIVYEV DGVLRGQSLM ALECPGGRHL TCHLHTTYRS KKPASALKMP GFHFEDHRIE ILEEVEKGKC
YKQYEAAVGR YCDAAPSKLG H

FIG. 7A(53)

```
SEQ ID NO: 87
>mRFP1
MASSEDVIKE FMRFKVRMEG SVNGHEFEIE GEGEGRPYEG TQTAKLKVTK GGPLPFAWDI LSPQFQYGSK
AYVKHPADIP DYLKLSFPEG FKWERVMNFE DGGVVTVTQD SSLQDGEFIY KVKLRGTNFP SDGPVMQKKT
MGWEASTERM YPEDGALKGE IKMRLKLKDG GHYDAEVKTT YMAKKPVQLP GAYKTDIKLD ITSHNEDYTI
VEQYERAEGR HSTGA
```

FIG. 7A(54)

```
SEQ ID NO: 88
>Jred
MDEDGSEGGP ALFQSDMTFK IFIDGEVNGQ KFTIVADGSS KFPHGDFNVH AVCETGKLPM SWKPICHLIQ
YGEPFFARYP NGISHFAQEC FPEGLSIDRT VRFENDGTMT SHHTYELDGT CVVSRITVNC DGFQPDGPIM
RDQLVDILPN ETHMFPHGPN AVRQLAFIGF TTADGGLMMG HFDSKMTFNG SRAIKIPGPH FVTIITKQMR
DTSDKRDHVC QREVTYAHSV PRITSAIGSD EDSGLRSRAQ ASNSAVDGTA GPGSTGSR
```

FIG. 7A(55)

```
SEQ ID NO: 89
>mCherry
MVSKGEEDNM AIIKEFMRFK VHMEGSVNGH EFEIEGEGEG RPYEGTQTAK LKVTKGGPLP FAWDILSPQF
MYGSKAYVKH PADIPDYLKL SFPEGFKWER VMNFEDGGVV TVTQDSSLQD GEFIYKVKLR GTNFPSDGPV
MQKKTMGWEA SSERMYPEDG ALKGEIKQRL KLDGGHYDA EVKTTYKAKK PVQLPGAYNV NIKLDITSHN
EDYTIVEQYE RAEGRHSTGG MDELYK
```

FIG. 7A(56)

```
SEQ ID NO: 90
>eqFP611
MNSLIKENMR MMVVMEGSVN GYQFKCTGEG DGNPYMGTQT MRIKVVEGGP LPFAFDILAT SFMYGSKTFI
KHTKGIPDFF KQSFPEGFTW ERVTRYEDGG VFTVMQDTSL EDGCLVYHAK VTGVNFPSNG AVMQKKTKGW
EPNTEMLYPA DGGLRGYSQM ALNVDGGGYL SCSFETTYRS KKTVENFKMP GFHFVDHRLE RLEESDKEMF
VVQHEHAVAK FCDLPSKLGR L
```

FIG. 7A(57)

```
SEQ ID NO: 91
>tdRFP611
MNSLIKENMR MMVVMEGSVN GYQFKCTGEG DGNPYMGTQT MRIKVVEGGP LPFAFDVLAT SFMYGSKTFI
KHTKGIPDFF KQSFPEGFTW ERVTRYEDGG VITVMQDTSL EDGCLVYHAK VRGVNFPSNG AVMQKKTKGW
EPNTEMLYPA DGGLRGYSQM ALNVDGGGYL FCSFETTYRS KKTDENFKMP GFHFVDHRLE RLEESDKEMF
VVQHEHAVAK FCDLPSKLGR L
```

FIG. 7A(58)

```
SEQ ID NO: 92
>HcRed1
MAGLLKESMR IKMYMEGTVN GHYFKCEGEG DGNPFAGTQS MRIHVTEGAP LPFAFDILAP CCEYGSRTFV
HHTAEIPDFF KQSFPEGFTW ERTTTYEDGG ILTAHQDTSL EGNCLIYKVK VHGTNFPADG PVMKNKSGGW
EPSTEVVYPE NGVLCGRNVM ALKVGDRHLI CHHYTSYRSK KAVRALTMPG FHFTDIRLQM LRKKKDEYFE
LYEASVARYS DLPEKAN
```

FIG. 7A(59)

SEQ ID NO: 93
>mRaspberry
MVSKGEEVIK EFMRFKVRME GSVNGHEFEI EGEGEGRPYE GTQTAKLKVT KGGPLPFAWD ILSPQCMYGS
KGYVKHPADI PDYLKLSFPE GFKWERVMNF EDGGVVTVTQ DSSLQDGEFI YKVKLRGTNF PSDGPVMQKK
TMGWEASSER MYPEDGALKG EMKMRLKLKD GGHYDAEVKT TYMAKKPVQL PGAYKTDIKL DITSHNEDYT
IVEQYERAEG RHSTGA

FIG. 7A(60)

SEQ ID NO: 94
>tdRFP639
MNSLIKENMR MMVVMEGSVN GYQFKCTGEG DGNPYMGTQT MRIKVVEGGP LPFAFDILAT SFMYGSKTFI
KHTKGIPDFF KQSFPEGFTW ERVTRYEDGG VFTVMQDTSL EDGCLVYHAK VRGVNFPSNG AVMQKKTKGW
EPSTEMLYPA DGGLRGYCQM ALNVDGGGYL FCSFETTYRS KKTDENFKMP GFHFVDHRLE RLEESDKEMF
VVQHEHAVAK FCDLPSKLGR L

FIG. 7A(61)

SEQ ID NO: 95
>mKate
MSELIKENMH MKLYMEGTVN NHHFKCTSEG EGKPYEGTQT MRIKVVEGGP LPFAFDILAT SFMYGSKTFI
NHTQGIPDFF KQSFPEGFTW ERVTTYEDGG VLTATQDTSL QDGCLIYNVK IRGVNFPSNG PVMQKKTLGW
EASTEMLYPA DGGLEGRSDM ALKLVGGGHL ICNLKTTYRS KKPAKNLKMP GVYYVDRRLE RIKEADKETY
VEQHEVAVAR YCDLPSKLGH K

FIG. 7A(62)

SEQ ID NO: 96
>mKate2
MVSELIKENM HMKLYMEGTV NNHHFKCTSE GEGKPYEGTQ TMRIKAVEGG PLPFAFDILA TSFMYGSKTF
INHTQGIPDF FKQSFPEGFT WERVTTYEDG GVLTATQDTS LQDGCLIYNV KIRGVNFPSN GPVMQKKTLG
WEASTETLYP ADGGLEGRAD MALKLVGGGH LICNLKTTYR SKKPAKNLKM PGVYYVDRRL ERIKEADKET
YVEQHEVAVA RYCDLPSKLG HR

FIG. 7A(63)

SEQ ID NO: 97
>Katushka
MSVLITENMH MKLYMEGTVN DHHFKCTSEG EGKPYEGTQT MKIKVVEGGP LPFAFDILAT SFMYGSKTFI
NHTQGIPDFF KQSFPEGFTW ERITTYEDGG VLTATQDTSL QNGCLIYNVK INGVNFPSNG PVMQKKTLGW
EASTEMLYPA DSGLRGHSQM ALKLVGGGYL HCSLKTTYRS KKPAKNLKMP GFYFVDRRLE RIKEADKETY
VEQHEMAVAR YCDLPSKLGH S

FIG. 7A(64)

SEQ ID NO: 98
>tdKatushka2
MSELIKENMH MKLYMEGTVN NHHFKCTSEG EGKPYEGTQT MKIKVVEGGP LPFAFDILAT SFMYGSKTFI
NHTQGIPDFF KQSFPEGFTW ERITTYEDGG VLTATQDTSL QNGCIIYNVK INGVNFPSNG SVMQKKTLGW
EANTEMLYPA DGGLRGHSQM ALKLVGGGYL HCSFKTTYRS KKPAKNLKMP GFHFVDHRLE RIKEADKETY
VEQHEMAVAK YCDLPSKLGH R

FIG. 7A(65)

SEQ ID NO: 99
>mPlum
MVSKGEEVIK EFMRFKEHME GSVNGHEFEI EGEGEGRPYE GTQTARLKVT KGGPLPFAWD ILSPQIMYGS
KAYVKHPADI PDYLKLSFPE GFKWERVMNF EDGGVVTVTQ DSSLQDGEFI YKVKVRGTNF PSDGPVMQKK
TMGWEASSER MYPEDGALKG EMKMRLRLKD GGHYDAEVKT TYMAKKPVQL PGAYKTDIKL DITSHNEDYT
IVEQYERAEG RHSTGA

FIG. 7A(66)

SEQ ID NO: 100
>AQ143
MAPLVTEDMC IKMTMEGTIN GHHFKCVGEG EGKPFEGTQV EKIRITEGGP LPFAYDILAP CCMYGSKTFI
KHVSGIPDYF KESFPEGFTW ERTQIFEDGG SLTIHQDTSL QGNNFIFKVN VIGANFPANG PVMQKKTAGW
EPSVEILYPR DGVLCGQALM ALKCTDGDHL TSHLRTTYRS RKPSNAVNMP EFHFGDHRIE ILKAEQGKFY
EQYESAVARY CEAAPSKLGH H

FIG. 7A(67)

SEQ ID NO: 101
>PA-GFP
MVSKGEELFT GVVPILVELD GDVNGHKFSV SGEGEGDATY GKLTLKFICT TGKLPVPWPT LVTTFSYGVQ
CFSRYPDHMK QHDFFKSAMP EGYVQERTIF FKDDGNYKTR AEVKFEGDTL VNRIELKGID FKEDGNILGH
KLEYNYNSHN VYIMADKQKN GIKANFKIRH NIEDGSVQLA DHYQQNTPIG DGPVLLPDNH YLSHQSALSK
DPNEKRDHMV LLEFVTAAGI TLGMDELYK

FIG. 7A(68)

SEQ ID NO: 102
>PS-CFP2
MSKGAELFTG IVPILIELNG DVNGHKFSVS GEGEGDATYG KLTLKFICTT GKLPVPWPTL VATLSYGVQC
FSRYPDHMKQ HDFFKSAMPE GYIQERTIFF EDDGNYKTRA EVKFEGDTLV SRIELTGTDF KEDGNILGNK
MEYNYNATNV YIVADKARNG IKVNFKVRHN IKDGSVQLAD HYQQNTPIGD GPVLLPDNHY LSTQSALSKD
PNEKRDHMIY LEFVTAAAIT HGMDELYK

FIG. 7A(69)

SEQ ID NO: 103
>PA-mCherry1
MVSKGEEDNM AIIKEFMRFK VHMEGSVNGH VFEIEGEGEG RPYEGTQTAK LKVTKGGPLP FTWDILSPQF
MYGSNAYVKH PADIPDYFKL SFPEGFKWER VMKFEDGGVV TVTQDSSLQD GEFIYKVKLR GTNFPSDGPV
MQKKTMGWEA LSERMYPEDG ALKGEVKPRV KLDGGHYDA EVKTTYKAKK PVQLPGAYNV NRKLDITSHN
EDYTIVEQYE RAEGRHSTGG MDELYK

FIG. 7A(70)

SEQ ID NO: 104
>Phamret
MVSKGEELFT GVVPILVELD GDVNGHRFSV SGEGEGDATY GKLTLKFICT TGKLPVPWPT LVTTLTWGVQ
CFARYPDHMK QHDFFKSAMP EGYVQERTIF FKDDGNYKTR AEVKFEGDTL VNRIELKGID FKEDGNILGH
KLEYNYISHN VYITADKQKN GIKAHFKIRH NIEDGGVQLA DHYQQNTPIG DGPVLLPDNH YLSTQSKLSK
DPNEKRDHMV LLEFVTAAGT KGEELFTGVV PILVELDGDV NGHKFSVSGE GEGDATYGKL TLKFICTTGK
LPVPWPTLVT TFSYGVQCFS RYPDHMKQHD FFKSAMPEGY VQERTIFFKD DGNYKTRAEV KFEGDTLVNR
IELKGIDFKE DGNILGHKLE YNYNSHNVYI MADKQKNGIK ANFKIRHNIE DGSVQLADHY QQNTPIGDGP
VLLPDNHYLS HQSALSKDPN EKRDHMVLLE FVTAAGITLG MDELYK*

FIG. 7A(71)

SEQ ID NO: 105
>Kaede
MSLIKPEMKI KLLMEGNVNG HQFVIEGDGK GHPFEGKQSM DLVVKEGAPL PFAYDILTTA FHYGNRVFAK
YPDHIPDYFK QSFPKGFSWE RSLMFEDGGV CIATNDITLK GDTFFNKVRF DGVNFPPNGP VMQKKTLKWE
ASTEKMYLRD GVLTGDITMA LLLKGDVHYR CDFRTTYKSR QEGVKLPGYH FVDHCISILR HDKDYNEVKL
YEHAVAHSGL PDNVK

FIG. 7A(72)

SEQ ID NO: 106
>KikGR1
MSVITSEMKI ELRMEGAVNG HKFVITGKGS GQPFEGIQNV DLTVIEGGPL PFAFDILTTA FHYGNRVFVE
YPEEIVDYFK QSFPEGYSWE RSMSYEDGGI CLATNNITMK KDGSNCFVNE IRFDGVNFPA NGPVMQRKTV
KWEPSTEKMY VRDGVLKGDV NMALLLQGGG HYRCDFRTTY KAKKVVQLPD YHFVDHQMEI TSHDKDYNKV
KLYEHAKAHS GLPRLAK

FIG. 7A(73)

SEQ ID NO: 107
>mKikGR
MSVITSEMKI ELRMEGSVNG HKFVITGKGS GRPYEGTQTV DLTVIEGGPL PFAFDILTTA FHYGNRVFVE
YPEEIVDYFK QSFPEGYSWE RSMSYEDGGI CLATNNITMK KDGSNTFVNE IRFDGTNFPA NGPVMQRKTV
KWEPSTEKMY VRDGVLKGDV EMALLLEGGG HYRCDFRTTY KAKKVVQLPD YHYVDHQMEI TSHDKDYNKV
KAYEHAKAYS GTYRGAKYEF EA

FIG. 7A(74)

SEQ ID NO: 108
>EosFP
MSAIKPDMKI NLRMEGNVNG HHFVIDGDGT GKPFEGKQSM DLEVKEGGPL PFAFDILTTA FHYGNRVFAE
YPDHIQDYFK QSFPKGYSWE RSLTFEDGGI CIARNDITME GDTFYNKVRF HGVNFPANGP VMQKKTLKWE
PSTEKMYVRD GVLTGDITMA LLLEGNAHYR CDFRTTYKAK EKGVKLPGYH FVDHCIEILS HDKDYNKVKL
YEHAVAHSGL PDNARR

FIG. 7A(75)

SEQ ID NO: 109
>d1EosFP
MSAIKPDMKI NLRMEGNVNG HHFVIDGDGT GKPFEGKQSM DLEVKEGGPL PFAFDILTTA FHYGNRVFAE
YPDHIQDYFK QSFPKGYSWE RSLTFEDGGI CIARNDITME GDTFYNKVRF HGTNFPANGP VMQKKTLKWE
PSTEKMYVRD GVLTGDITMA LLLEGNAHYR CDFRTTYKAK EKGVKLPGYH FVDHCIEILS HDKDYNKVKL
YEHAVAHSGL PDNARR

FIG. 7A(76)

SEQ ID NO: 110
>mEos2
MSAIKPDMKI KLRMEGNVNG HHFVIDGDGT GKPFEGKQSM DLEVKEGGPL PFAFDILTTA FHYGNRVFAK
YPDNIQDYFK QSFPKGYSWE RSLTFEDGGI CIARNDITME GDTFYNKVRF YGTNFPANGP VMQKKTLKWE
PSTEKMYVRD GVLTGDIHMA LLLEGNAHYR CDFRTTYKAK EKGVKLPGYH FVDHCIEILS HDKDYNKVKL
YEHAVAHSGL PDNARR

FIG. 7A(77)

SEQ ID NO: 111
>Dendra2
MNTPGINLIK EDMRVKVHME GNVNGHAFVI EGEGKGKPYE GTQTANLTVK EGAPLPFSYD ILTTAVHYGN
RVFTKYPEDI PDYFKQSFPE GYSWERTMTF EDKGICTIRS DISLEGDCFF QNVRFKGTNF PPNGPVMQKK
TLKWEPSTEK LHVRDGLLVG NINMALLLEG GGHYLCDFKT TYKAKKVVQL PDAHFVDHRI EILGNDSDYN
KVKLYEHAVA RYSPLPSQVW

FIG. 7A(78)

SEQ ID NO: 112
>Dronpa
MSVIKPDMKI KLRMEGAVNG HPFAIEGVGL GKPFEGKQSM DLKVKEGGPL PFAYDILTTV FCYGNRVFAK
YPENIVDYFK QSFPEGYSWE RSMNYEDGGI CNATNDITLD GDCYIYEIRF DGVNFPANGP VMQKRTVKWE
PSTEKLYVRD GVLKGDVNMA LSLEGGGHYR CDFKTTYKAK KVVQLPDYHF VDHHIEIKSH DKDYSNVNLH
EHAEAHSELP RQAK

FIG. 7A(79)

SEQ ID NO: 113
>Dronpa-3
MSVIKPDMKI KLRMEGAVNG HPFAIEGVGL GKPFEGKQSM DLKVKEGGPL PFAYDILTTV FCYGNRVFAK
YPENIVDYFK QSFPEGYSWE RSMNYEDGGI CNATNDITLD GDCYIYEIRF DGVNFPANGP VMQKRTVKWE
PSTEKLYVRD GVLKGDINAA LSLEGGGHYR CDFKTTYKAK KVVQLPDYHF VDHHIEIKSH DKDYSNVNLH
EHAEAHSELP RQAK

FIG. 7A(80)

SEQ ID NO: 114
>rsFastLime
MSVIKPDMKI KLRMEGAVNG HPFAIEGVGL GKPFEGKQSM DLKVKEGGPL PFAYDILTTV FCYGNRVFAK
YPENIVDYFK QSFPEGYSWE RSMNYEDGGI CNATNDITLD GDCYIYEIRF DGVNFPANGP VMQKRTVKWE
PSTEKLYVRD GVLKGDGNMA LSLEGGGHYR CDFKTTYKAK KVVQLPDYHF VDHHIEIKSH DKDYSNVNLH
EHAEAHSELP RQAK

FIG. 7A(81)

SEQ ID NO: 115
>Padron
MSVIKPDMKI KLRMEGAVNG HPFAIEGVGL GKPFEGKQSM DLKVKEGGPL PFAYDILTMA FCYGNRVFAK
YPENIVDYFK QSFPEGYSWE RSMIYEDGGI CNATNDITLD GDCYIYEIRF DGVNFPANGP VMQKRTVKWE
LSTEKLYVRD GVLKSDGNYA LSLEGGGHYR CDFKTTYKAK KVVQLPDYHS VDHHIEIKSH DKDYSNVNLH
EHAEAHSELP RQAK

FIG. 7A(82)

SEQ ID NO: 116
>bsDronpa
MSVIKPDMKI KLRMEGAVNG HPFAIEGVGL GKPFEGKQSM DLKVKEGGPL PFAYDILTTA FCYGNRVFTK
YPENIVDYFK QSFPEGYSWE RSMNYEDGGI CNATNDITLD GNCYIYEIRF DGVNFPANGP VMQKRTVKWE
QSTEKLYVRD GVLKSDGNCA LSLEGGGHYR CDCKTTYKAK KVVQLPDYHF VDHHIEIKSH DKDYSNVNLH
EHAEAHSELP RQAK

FIG. 7A(83)

SEQ ID NO: 117
>KFP1
MASLLTETMP FKTTIEGTVN GHCFKCIGKG EGNPFEGTQE MKIEVIEGGP LPFAFHILST SCMYGSKTFI
KYVSGIPDYF KQSFPEGFTW ERTTTYEDGG FLTAHQDTSL DGDCLVYKVK ILGNNFPADG PVMQNKVGRW
EPGTEIVYEV DGVLRGQSLM ALKCPGGRHL TCHLHTTYRS KKPASALKMP GFHFEDHRIE IMEEVEKGKC
YKQYEAAVGR YCDAAPSKLG HN

FIG. 7A(84)

SEQ ID NO: 118
>mTFP0.7
MVSKGEETTM GVIKPDMKIK LKMEGNVNGH AFVIEGEGEG KPYDGTNTIN LEVKEGAPLP FSYDILTNAF
AYGNRAFTKY PDDIPNYFKQ SFPEGYSWER TMTFEDKGIV KVKSDISMEE DSFIYEIHLK GENFPPNGPV
MQKKTLKWEP STEILYVRDG VLVGDIKHKL LLEGGGHHRV DFKTIYRAKK AVKLPDYHFV DHRIEILNHD
KDYNKVTVYE SAVARYSTGG MDELYK

FIG. 7A(85)

SEQ ID NO: 119
>rsCherry
MVSKGEEDNM AIIKEFMRFK VHMEGSVNGH EFEIEGEGEG RPYEGTQTAK LKVTKGGPLP FAWDILSPQF
MYGSKAYVKH PADIPDYLKL SFPEGFKWER VMNFEDGGVV TVTQDSSLQD GEFIYKVKLR GTNFPSDGPV
MQKKTMGWVA SSERMYPEDG ALKGESKQRL KLKDGGHYDA EFWTTYKAKK PVQLPGAYNV NIKLDITSHN
EDYTIVEQYE RAEGRHSTGG MDELYK

FIG. 7A(86)

SEQ ID NO: 120
>rsCherryRev
MVSKGEEDNM AIIKEFMRFK VHMEGSVNGH EFEIEGEGEG RPYEGTQTAK LKVTKGGPLP FAWDILSPQF
MYGSKAYVKH PADIPDYLKL SFPEGFKWER VMNFEDGGVV TVTQDSSLQD GEFIYKVKLR GTNFPSDGPV
MQKKTMGWVA CSERMYPEDG ALKGESKMRL KLKDGGHYDA EFKTTYKAKK PVQLPGAYNV NIKLDITSHN
EDYTIVEQYE RAEGRHSTGG MDELYK

FIG. 7A(87)

SEQ ID NO: 121
>IrisFP
MSAIKPDMKI NLRMEGNVNG HHFVIDGDGT GKPFEGKQSM DLEVKEGGPL PFAFDILTTA FHYGNRVFAE
YPDHIQDYFK QSFPKGYSWE RSLTFEDGGI CIARNDITME GDTFYNKVRF HGVNFPANGP VMQKKTLKWE
PSTEKMYVRD GVLTGDITMA LLLEGNAHYR CDSRTTYKAK EKGVKLPGYH LVDHCIEILS HDKDYNKVKL
YEHAVAHSGL PDNARR

FIG. 7A(88)

SEQ ID NO: 122
>UNIPROT:CONA_CANCT P81461 Concanavalin-A (Con A)
ADTIVAVELDTYPNTDIGDPSYPHIGIDIKSVRSKKTAKWNMQNGKVGTAHIIYNSVGKR
LSAVVSYPNGDSATVSYDVDLDNVLPEWVRVGLSASTGLYKETNTILSWSFTSKLKSNST
HETNALHFMFNQFSKDQKDLILQGDATTGTDGNLELTRVSSNGSPQGNSVGRALFYAPVH
IWESSAVVASFDATFTFLIKSPDSHPADGIAFFISNIDSSIPSGSTGRLLGLFPDAN

FIG. 8A(1)

SEQ ID NO: 123
>UNIPROT:CONV_CANCT C0HJY1 Concanavalin V {ECO:0000303|PubMed:24519628} (ConV
{ECO:0000303|PubMed:24519628})
ADTIVAVELDTYPNTDIGDPSYPHIGIDIKSVRSKKTAKWNMQNGKVGTAHIIYNSVGKR
LSAVVSYPNGDSATVSYDVDLDNVLPEWVRVGLSASTGLYKETNTILSWSFTSKLKSNST
HETNALHFVFNQFSKDQKDLILQGDATTGTDGNLELTRVSSNGSPQGSSVGRALFYAPVH
IWESSAVVASFDATFTFLIKSPDSHPADGIAFFISNIDSSIPSGSTGRLLGLFPDAN

FIG. 8A(2)

SEQ ID NO: 124
>UNIPROT:CONA_CANLI P81460 Concanavalin-A (Con A)
ADTIVAVELDTYPNTDIGDPSYPHIGIDIKSVRSKKTAKWNMQNGKVGTAHIIYNSVGKR
LSAVVSYPNGDSATVSYDVDLDNVLPEWVRVGLSASTGLYKETNTILSWSFTSKLKSNST
HETNALHFVFNQFSKDQKDLILQGDATTGTDGNLELTRVSSNGSPQGNSVGRALFYAPVH
IWESSAVVASFDATFTFLIKSSDSHPADGIAFFISNIDSSIPSGSTGRLLGLFPDAN

FIG. 8A(3)

SEQ ID NO: 125
>UNIPROT:CONA_CANBR P55915 Concanavalin-Br (Con Br)
ADTIVAVELDTYPNTDIGDPSYPHIGIDIKSVRSKKTAKWNMQNGKVGTAHIIYNSVGKR
LSAVVSYPNGDSATVSYDVDLDNVLPEWVRVGLSASTGLYKETNTILSWSFTSKLKSNST
HETNALHFMFNQFSKDQKDLILQGDATTGTEGNLRLTRVSSNGSPQGSSVGRALFYAPVH
IWESSAVVASFEATFTFLIKSPDSHPADGIAFFISNIDSSIPSGSTGRLLGLFPDAN

FIG. 8A(4)

SEQ ID NO: 126
>UNIPROT:LECA_CANBL A0A023GPI8 Lectin alpha chain {ECO:0000303|PubMed:24865454} (CboL
{ECO:0000303|PubMed:19705102, ECO:0000303|PubMed:24865454}) (Lectin beta chain
{ECO:0000303|PubMed:24865454}) (Lectin gamma chain {ECO:0000303|PubMed:24865454})
ADTIVAVELDTYPNTDIGDPSYPHIGIDIKSVRSKKTAKWNMQNGKVGTAHIIYNSVGKR
LSAVVSYPNGDSATVSYDVDLDNVLPEWVRVGLSATTGLYKETNTILSWSFTSKLKSNST
HETNALHFMFNQFSKDQKDLILQGDATTGRDGNLELTRVSSNGSPQGSSVGRALFYAPVH
IWESSAVVASFDATFTFLIKSSDSHPADGIAFFISNIDSSIPSGSTGRLLGLFPDAN

FIG. 8A(5)

SEQ ID NO: 127
>UNIPROT:LECA_CANGR A0A067XG71 Lectin ConGF {ECO:0000303|PubMed:22368061}
ADTIVAVELDTYPNTDIGDPNYPHIGIDIKSIRSKKIAKWNMQDGKVATAHIIYNSVGKR
LSAVVSYPNADSATVSYDVDLDNVLPEWVRVGLSATTGLYKETNTILSWSFTSKLKSNST
AETNALHFTFNQFTKDQKDLILQGDATTDSDGNLQLTRVSSDGTPQGNSVGRALFYAPVH
IWESSAVVASFDATFTFLIKSPDSDPADGITFFISNMDSTIPSGSGGRLLGLFPDAN

FIG. 8A(6)

SEQ ID NO: 128
>UNIPROT:CONA_CANRO P81364 Concanavalin-Ma (Con Ma)
ADTIVAVELDTYPNTDVGDPSYPHXXXXXXSVRXXTAKWNMQNGKVGTAHISYNSVGKRL
SAVVSYPNGDSATVSYDVDLDNVLPEWVRVGLSASTGLYKETNTILSWSFTSKLKSNSTH
ETNALHFMFNQFTKDQKDLILQSDATTGTDGNLXXTRVSSNGPSQGSTVGRALFYAPVHI
WESSATVAGFDATFXXLIKSPDSHPADGIAFFISNIDSSIPSGSTGRLLGLFPDAN

FIG. 8A(7)

SEQ ID NO: 129
>UNIPROT:D5MNX4_CYMRO D5MNX4 (Cymbosema roseum mannose-specific lectin
{ECO:0000313|PDB:3A0K})
ADTIVAVELDSYPNTDIGDPSYPHIGIDIKSIRSKSTARWNMQTGKVGTAHISYNSVAKR
LTAVVSYSGSSSTTVSYDVDLTNVLPEWVRVGLSATTGLYKETNTILSWSFTSKLKTNSI
ADANALHFSFNQFTQNPKDLILQGDATTDSDGNLELTKVSSSGSPQGSSVGRALFYAPVH
IWESSAVVASFDATFTFLIKSPDSEPADGITFFIANTDTSIPSGSSGRLLGLFPDAN

FIG. 8A(8)

SEQ ID NO: 130
>UNIPROT:LECA_CYMRO P86184 Mannose-specific lectin alpha chain {ECO:0000303|Ref.1}
(Mannose-specific lectin beta chain {ECO:0000303|Ref.1}) (Mannose-specific lectin
gamma chain {ECO:0000303|Ref.1})
ADTIVAVELDSYPNTDIGDPSYPHIGIDIKSIRSKSTARWNMQTGKVGTAHISYNSVAKR
LTAVVSYSGSSSTTVSYDVDLNNVLPEWVRVGLSATTGLYKETNTILSWSFTSKLKTNSI
ADANALHFSFHQFTQNPKDLILQGDATTDSDGNLELTKVSSSGSPQGSSVGRALFYAPVH
IWESSAVVASFDATFTFLIKSPDSEPADGITFFIANTDTSIPSGSSGRLLGLFPDAN

FIG. 8A(9)

SEQ ID NO: 131
>UNIPROT:LECA_DIOVI P58907 Lectin alpha chain (Lectin beta chain) (Lectin gamma-1
chain) (Lectin gamma-2 chain)
ADTIVAVELDSYPNTDIGDPSYPHIGIDIKSVRSKSTARWNMQTGKVGTAHISYNSVAKR
LSAVVSYTGSSSTTVSYDVDLNNVLPEWVRVGLSATTGLYKETNTILSWSFTSKLKTNSI
ADANSLHFSFNQFSQNPKDLILQGDATTDSDGNLQLTRVSSDGSPQGSSVGRALFYAPVH
IWEKSAVVASFDATFTFLIKSPDRDPADGITFFIANTDTSIPSGSGGRLLGLFPDAN

FIG. 8A(10)

SEQ ID NO: 132
>UNIPROT:LECA_DIORO P58908 Lectin alpha chain (Lectin beta chain) (Lectin gamma-1
chain) (Lectin gamma-2 chain)
ADTIVAVELDSYPNTDIGDPNYPHIGIDIKSIRSKSTARWNMQTGKVGTVHISYNSVAKR
LSAVVSYTGSSSTTVSYDVDLNNVLPEWVRVGLSATTGLYKETNTILSWSFTSKLKTNSI
ADANSLHFTFNQFSQNPKDLILQGDATTDSDGNLELTKVSSSGDPQGNSVGRALFYAPVH
IWEKSAVVASFDATFTFLIKSPDRDPADGITFFIANPDTSIPSGSGGRLLGLFPDAN

FIG. 8A(11)

SEQ ID NO: 133
>UNIPROT:LECA_DIOGU P81637 Lectin alpha chain (Lectin beta chain) (Lectin gamma-1
chain) (Lectin gamma-2 chain)
ADTIVAVELDSYPNTDIGDPSYPHIGIDIKSIRSKSTARWNMQTGKVGTAHISYNSVAKR
LSAVVSYTGSSSTTVSYDVDLNNVLPEWVRVGLSATTGLYKETNTILSWSFTSKLKTNSI
ADANSLHFSFNQFSQNPKDLILQSDATTDSDGNLELTKVSSSGDPQGSSVGRALFYAPVH
IWEKSAVVAGFDATFTFLIKSPDRDPADGITFFIANTDTSIPSGSGGRLLGLFPDAN

FIG. 8A(12)

SEQ ID NO: 134
>UNIPROT:LECA_DIOGR P08902 Lectin alpha chain (Lectin beta chain) (Lectin gamma chain)
ADTIVAVELDSYPNTDIGDPNYPHIGIDIKSIRSKSTARWNMQTGKVGTVHISYNSVAKR
LSAVVSYSGSSSTTVSYDVDLNNVLPEWVRVGLSATTGLYKETNTILSWSFTSKLKTNSI
ADENSLHFSFHKFSQNPKDLILQGDAFTDSDGNLELTKVSSSGDPQGNSVGRALFYAPVH
IWESSAVVASFDATFTFLIKSPDREPADGITFFIANTDTSIPSGSGGRLLGLFPDAN

FIG. 8A(13)

SEQ ID NO: 135
>UNIPROT:LECA_BIOPE J9PBR3 Lectin CPL {ECO:0000303|PubMed:22554687}
ADTIVAVELDTYPNTDIGDPNYQHIGINIKSIRSKATTRWNVQDGKVGTAHISYNSVAKR
LSAIVSYPGGSSATVSYDVDLNNILPEWVRVGLSASTGVYKETNTILSWSFTSKLKTNST
ADAQSLHFTFNQFSQSPKDLILQGDASTDSDGNLQLTRVSNGSPQSNSVGRALYYAPVHV
WDKSAVVASFDATFTFLIKSPDSDPADGIAFFIANTDSSIPHGSGGRLLGLFPDAN

FIG. 8A(14)

SEQ ID NO: 136

>UNIPROT:I1SB09_DIOVO I1SB09 (Lectin {ECO:0000313|PDB:3AX4})
ADTIVAVELDSYPNTDIGDPNYPHIGIDIKSIRSKSTARWNMQTGKVGTVHISYNSVAKR
LSAVVSYSGSSSTTVSYDVDLNNVLPEWVRVGLSATTGLYKETNTILSWSFTSKLKTNSA
ADENSLHFSFHKFSQNPKDLILQGDAFTDSDGNLELTKVSSSGDPQGNSVGRALFYAPVH
IWEKSAVVASFDATFTFLIKSPDREPADGITFFIANTDTSIPSGSGGRLLGLFPDAN

FIG. 8A(15)

SEQ ID NO: 137
>UNIPROT:LECA_DIOWI P86624 Lectin alpha chain {ECO:0000303|PubMed:21694673} (DwL
{ECO:0000303|PubMed:21694673}) (Lectin beta chain {ECO:0000303|PubMed:21694673})
(Lectin gamma chain {ECO:0000303|PubMed:21694673})
ADTIVAVELDSYPNTDIGDPNYPHIGIDIKSIRSKSTARWNMQTGKVGTVHISYNSVAKR
LSAVVSYSGSSSTTVSYDVDLNNVLPEWVRVGLSATTGLYKETNTILSWSFTSKLKTNSI
ADENSLHFSFHKFSQNPKDLILQGDAFTDSDGNLELTKVSNSGDPQGNSVGRALFYAPVH
IWEKSAVVASFDATFTFLIKSPDREPADGITFFIANTDTSIPSGSGGRLLGLFPDAN

FIG. 8A(16)

SEQ ID NO: 138
>UNIPROT:LECA_DIOSC B3EWJ2 Lectin alpha chain {ECO:0000303|PubMed:22037666} (DSL
{ECO:0000303|PubMed:22037666}) (Lectin beta chain {ECO:0000303|PubMed:22037666})
(Lectin gamma chain {ECO:0000303|PubMed:22037666})
ADTIVAVELDSYPNTDIGDPNYPHIGIDIKSIRSKSTARWNMQTGKVGTVHISYNSVAKR
LSAVVSYSGSSSTTVSYDVDLNNVLPEWVRVGLSATTGLYKETNTILSWSFTSKLKTNSI
ADENSLHFSFHKFSQNPKDLILQGDAFTDSDGNLQLTKVSSSGDPQGNSVGRALFYAPVH
IWEKSAVVASFDATFTFLIKSPDREPADGITFFIANTDTSIPSGSGGRLLGLFPDAN

FIG. 8A(17)

SEQ ID NO: 139
>UNIPROT:LECA_DIORF C0HK81 Lectin {ECO:0000303|PubMed:26464029} (DrfL
{ECO:0000303|PubMed:26464029})
ADTIVAVELDSYPNTDIGDPNYPHIGIDIKSVRSKSTARWNMQTGKVGTVHISYNSVSKR
LSAVVSYSGSSSTTVSYDVDLNNVLPEWVRVGLSATTGLYKQTNTILSWSFTSKLKTNSI
ADENSLHFSFHKFSQNPKDLILQGDASTDSDGNLQLTKVSSSGDPQGNSVGRALFYAPVH
IWEKSAVVASFDATFTFLIKSPDREPADGITFFIANTDTTIPSGSGGRLLGLFPDAN

FIG. 8A(18)

```
SEQ ID NO: 140
>UNIPROT:LECA_CRAAG P81517 Lectin alpha chain (Lectin beta chain) (Lectin gamma chain)
ADTIVAVELDTYPNTDIGDPNYQHIGINIKSIRSKATTRWNVQDGKVGTAHISYNSVAKR
LSAIVSYPGGSSATVSYDVDLNNILPEWVRVGLSASTGLYKETNTILSWSFTSKLKTNST
ADAQSLHFTFNQFSQNPKDLILQGDASTDSDGNLQLTRVSNGSPQSNSVGRALYYAPVHV
WDKSAVVASFDATFTFLIKSTDSDIADGIAWFIANTDSSIPHGSGGRLLGLFPDAN
```

FIG. 8A(19)

```
SEQ ID NO: 141
>UNIPROT:LEC1_CRAMO P83721 Mannose/glucose-specific lectin Cramoll (Iso1) (Cramoll
alpha chain) (Cramoll beta chain) (Fragments)
ADTIVAVELDTYPNTDIGDPSYQHIGINIKSIRSKATTRWDVQNGKVGTAHISYNSVAKR
LSAVVSYPGGSSATVSYDVDLNNILPEWVRVGLSASTGLYKETNTILSWSFTSKSNSTAD
AQSLHFTFNQFSQSPKDLILQGDASTDSDGNLQLTRVSNGSPQSDSVGRALYYAPVHIWD
KSAVVASFDATFTFLIKSPDREIADGIAFFIANTDSSIPHGSGGRLLGLFPDAN
```

FIG. 8A(20)

```
SEQ ID NO: 142
>UNIPROT:CONA_CANGL P14894 Concanavalin-A (Con A) (Precursor)
MAISKKSSLFLPIFTFITMFLMVVNKVSSSTHETNALHFMFNQFSKDQKDLILQGDATTG
TDGNLELTRVSSNGSPQGSSVGRALFYAPVHIWESSAVVASFDATFTFLIKSPDSHPADG
IAFFISNIDSSIPSGSTGRLLGLFPDANVIRNSTTIDFNAAYNADTIVAVELDTYPNTDI
GDPNYPHIGIDIKSVRSKKTAKWNMQNGKVGTAHIIYNSVGKRLSAVVSYPNGDSATVSY
DVDLDNVLPEWVRVGLSASTGLYKETNTILSWSFTSKLKSNEIPDIATVV
```

FIG. 8A(21)

```
SEQ ID NO: 143
>UNIPROT:A0A6M6R659_CANRO A0A6M6R659 (Concanavalin {ECO:0000313|EMBL:QJZ28375.1})
MAISKKSSLFLPIFTFITMFLMVVNKVSSSTHETNALHFMFNQFSKDQKDLILQGDATTG
TDGNLELTRVSSNGSPQGNSVGRALFYAPVHIWESSAVVASFDATFTFLIKSSDSHPADG
IAFFISNIDSSIPSGSTGRLLGLFPDANVIRNSTTIDFNAAYNADTIVAVELDTYPNTDI
GDPSYPHIGIDIKSVRSKKTAKWNMQNGKVGTAHIIYNSVGKRLSAVVSYPNGDSATVSY
DVDLDNVLPEWVRVGLSASTGLYKETNTILSWSFTSKLKSNEIPDIATVV
```

FIG. 8A(22)

```
SEQ ID NO: 144
>UNIPROT:A0A6M6R977_CANCT A0A6M6R977 (Concanavalin {ECO:0000313|EMBL:QJZ28374.1})
MAISKKSSLFLPIFTFITMFLMVVNKVSSSTHETNALHFVFNQFSKDQKDLILQGDATTG
TDGNLELTRVSSNGSPQGNSVGRALFYAPVHIWESSAVVASFDATFTFLIKSSDSHPADG
IAFFISNIDSSIPSGSTGRLLGLFPDANVIRNSTTIDFNAAYNADTIVAVELDTYPNTDI
GDPSYPHIGIDIKSVRSKKTAKWNMQNGKVGTAHIIYNSVGKRLSAVVSYPNGDSATVSY
DVDLDNVLPEWVRVGLSASTGLYKETNTILSWSFTSKLKSNEIPDIATVV
```

FIG. 8A(23)

```
SEQ ID NO: 145
>UNIPROT:O04672_CANBR O04672 (Lectin {ECO:0000313|EMBL:CAA74202.1}) (Fragment)
MAISKKSSLFLPIFTFITMFLMVVNKVSSSTHETNALHFMFNQFSKDQKDLILQGDATTG
TDGNLELTRVSSNGSPQGSSVGRALFYAPVHIWESSAVVASFEATFTFLIKSPDSHPADG
IAFFISNIDSSIPSGSTGRLLGLFPDANVIRNSTTIDFNAAYNADTIVAVELDTYPNTDI
GDPSYPHIGIDIKSVRSKKTAKWNMQNGKVGTAHIIYNSVGKRLSAVVSYPNGDSATVSY
DVDLDNVLPEWVRVGLSASTGLYKETNTILSWSFTSKLKSNEIPDIATVV
```

FIG. 8A(24)

```
SEQ ID NO: 146
>UNIPROT:CONA_CANEN P02866 Concanavalin-A (Con A) (Precursor)
MAISKKSSLFLPIFTFITMFLMVVNKVSSSTHETNALHFMFNQFSKDQKDLILQGDATTG
TDGNLELTRVSSNGSPQGSSVGRALFYAPVHIWESSAVVASFEATFTFLIKSPDSHPADG
IAFFISNIDSSIPSGSTGRLLGLFPDANVIRNSTTIDFNAAYNADTIVAVELDTYPNTDI
GDPSYPHIGIDIKSVRSKKTAKWNMQNGKVGTAHIIYNSVDKRLSAVVSYPNADSATVSY
DVDLDNVLPEWVRVGLSASTGLYKETNTILSWSFTSKLKSNEIPDIATVV
```

FIG. 8A(25)

```
SEQ ID NO: 147
>UNIPROT:A8WDZ4_CANEN A8WDZ4 (Concanavalin A {ECO:0000313|EMBL:ABW87339.1})
MAISKKSSLFLPIFTFITMFLMVVNKVSSSTHETNALHFMFNQFSKDQKDLILQGDATTG
TDGNLELTRVSSNGSPQGSSVGRALFYAPVHIWESSAVVASFEATFTFLIKSPDSHPADG
IAFFISNIDSSIPSGSTGRLLGLFPDANVIRNSTTIDFNAAYNADTIVAVELDTYPNTDI
GDPSYPHIGIDIKSVRSKKTAKWNMQNGKVGTAHIIYNSVDKRLSAVVSYPNADSATVSY
DVDLDNVLPEWVRVGLSASTGLYKETNTILSWSFTSKLKSNEIPDIATVV
```

FIG. 8A(26)

```
SEQ ID NO: 148
>UNIPROT:LECA_CANBN P58906 Lectin CaBo {ECO:0000303|Ref.1} (Lectin Cbo
{ECO:0000303|PubMed:10082964}) (Fragment) (Precursor)
MAISKKSSLYLPIFTFITMLLMVVNKVSSSTADANALHFTFNQFSKDQKDLILQGDATTG
TDGNLELTRVSSNGSPQGNSVGRALFYAPVHIWESSAVVASFDATFKFLIKSPDSEPADG
ITFFIANIDSSIPSGSGGRLLGLFPDANIIKNSTTIDFNAAYNADTIVAVELDTYPNTDI
GDPNYPHIGIDIKSIRSKKTTRWNIQNGKVGTAHINYNSVGKRLSAIVSYPNSDSATVSY
DVDLDNVLPEWVRVGLSATTGLYKETNTILSWSFTSKLKSN
```

FIG. 8A(27)

```
SEQ ID NO: 149
>UNIPROT:LECA_DIOLA C0HK27 Lectin {ECO:0000303|PubMed:24008245} (DlyL
{ECO:0000303|PubMed:24008245}) (Precursor)
MGISKKSQLVPLLAFITMFLMVVSRVSSSIADANSLHFSFSQFSQNPKDLILQGDATTDS
DGNLQLTRVSSDGSPQGSSVGRALFYAPVHIWEKSAVVASFDATFTFLIKSPDRDPADGI
TFFIANTDTSIPSGSGGRLLGLFPDANIIKNSTNLDFNAAYNADTIVAVELDSYPNTDIG
DPSYPHIGIDIKSIRSKSTARWNMQTGKVGTAHISYNSVAKRLSAVVSYSGTSSTTVSYD
VDLNNVLPEWVRVGLSATTGLYKETNTILSWSFTSKLKTNQLQDLRIASVV
```

FIG. 8A(28)

```
SEQ ID NO: 150
>UNIPROT:A9J248_DIOGU A9J248 (Lectin {ECO:0000313|EMBL:CAM91961.1})
MGISKKSQLVPLLAFITMFLIVVSRVSSSIADANSLHFSFSQFSQNPKDLILQGDATTDS
DGNLQLTRVSSDGSPQGSSVGRALFYAPVHIWEKSAVVASFDATFTFLIKSPDRDPADGI
TFFIANTDTSIPSGSGGRLLGLFPDANIIKNSTNLDFNAAYNADTIVAVELDSYPNTDIG
DPSYPHIGIDIKSIRSKSTARWNMQTGKVGTAHISYNSVAKRLSAVVSYSGTSSTTVSYD
VDLNNVLPEWVRVGLSATTGLYKETNTILSWSFTSKLKTNQLQDLRIASVV
```

FIG. 8A(29)

```
SEQ ID NO: 151
>UNIPROT:A9J251_DIOGR A9J251 (Lectin {ECO:0000313|EMBL:CAM91962.1}) (Fragment)
LIVVSRVSSSIADENSLHFSFHKFSQNPKDLILQGDAFTDSDGNLQLTKVSSSGDPQGNS
VGRALFYAPVHIWEKSAVVASFDATFTFLIKSPDREPADGITFFIANTDTSIPSGSGGRL
LGLFPDANIVKNSTTLDFNAAYNADTIVAVELDSYPNTDIGDPNYPHIGIDIKSIRSKST
ARWNMQTGKVGTVHISYNSVAKRLSAVVSYSGSSSTTVSYDVDLNNVLPEWVRVGLSATT
GLYKETNTILSWSFTSKLKTN
```

FIG. 8A(30)

SEQ ID NO: 152
>UNIPROT:A0A444XTI8_ARAHY A0A444XTI8 (Uncharacterized protein
{ECO:0000313|EMBL:RYQ92774.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGIDVNSIRSSKVCYWNFHDAAITTAKITYNSAHKKL
TVHVSTYLHSQPDTLTYDVDLSTKLPEKVKIGISASTGQFSQTTEILSWIFKSLASHFIS
KNHKIIAMGVSFNLHKFDPKHSKEIQFQGDATITDHHIIRLTNLDDDGNPLGNRVGRVLF
SDPVHLYDHSGLRAGFETTFVIKTITTAKITYNSAYKKLTVHVSTYLHSQPDTLTYDVDL
STKLPEKVKIGISASTGQFSQTTEILSWIFKQDCPLLLFVFGFGFLSYVIYAWMLTLFSS
FLPLFLPSVFSKAMHVKNNDLSNIFCILFLLIITCYTTY

FIG. 8A(31)

SEQ ID NO: 153
>UNIPROT:A0A444XSR3_ARAHY A0A444XSR3 (Uncharacterized protein
{ECO:0000313|EMBL:RYQ92773.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGIDVNSIRSSKVCYWNFHDAAITTAKITYNSAHKKL
TVHVSTYLHSQPDTLTYDVDLSTKLPEKVKIGISASTGQFSQTTEILSWIFKSLASHFIS
KNHKIIAMGVSFNLHKFDPKHSKEIQFQGDATITDHHIIRLTNLDDDGNPLGNRVGRVLF
SDPVHLYDHSGLRAGFETTFHSKEIQFQGDATITDHHIIRLTNLDDDGNPLGNRVGRVLF
SDPVHLYDHSGLRAGFETTFVFRISKPYNTEYTPGPGDGLAFFLASADTEIPPESSGKFL
GLFNDASDRIVAVEFDTFSNSDIGDPNYPHIGIDVNSIRSSKVCYWNFHDAAITTAKITY
NSAHKKLTVHVSTYLHSQPDTLTYDVDLSTKLPEKVKIGISASTGQFSQTTEILSWIFKS
N

FIG. 8A(32)

SEQ ID NO: 154
>UNIPROT:A0A1S3V2P1_VIGRR A0A1S3V2P1 (flt3 receptor-interacting lectin-like
{ECO:0000313|RefSeq:XP_014512565.1})
MAVSSTNYSFLIAVFAFVTMLLMFPNKVKSAQSLSFSFSRFGPDHKDLIFQGDAISTNNV
LQLTKLDSAGNPLSGSVGRVLYSAPLHLWENSAVVSSFETSFTFQISTPYTSPPADGVAF
FLAPYDTVIPSNSGGSLLGLFSNLNALRNSSTSQNQTILDFKAVSNKVVAVEFDTYPNEN
IGDPAYKHIGIDVNSIRSKTTARWNWQNGKTATAHISYNSASKRLTVSTFYPGSNPVTLS
YDVELHTVLSEWVRVGFSASSGEQKERNTILSWSFTSSLKNNEVKDEKQDMFIKTVV

FIG. 8A(33)

SEQ ID NO: 155
>UNIPROT:A0A4D6N5M4_VIGUN A0A4D6N5M4 (Legume lectin {ECO:0000313|EMBL:QCE08202.1})
MAISDKNNPFIIPLLAFMTMLCMFPGKVKSAESLSFSFSKFGSDQKDLIFQGDAISTNNV
LQLTKLNSAGNPVGVSVGRVLYSAPLRLWGDSAVLSSFDTTATFQISTPYVSYADGIAFF
LAPHDTVIPPNSNGRLLGLFSNNINAFKNSSTSVNKTTVDFKAATNNVVAVEFDTYPNVD
FGDPPYIHVGIDVNSIISKATARWNWQNGKIATVHITYNSASKRLTASIYYPGGTPVTVS
YDVQLQTVLPQWVRVGWSASTGAEAQRNTLLSWSFSSSLKNNDVKEEKEDTFITTVV

FIG. 8A(34)

SEQ ID NO: 156
>UNIPROT:A0A0B2QQ14_GLYSO A0A0B2QQ14 (Concanavalin-A {ECO:0000313|EMBL:KHN21742.1})
(Flt3 receptor-interacting lectin {ECO:0000313|EMBL:RZB88779.1})
MKAPRLFQALKPPLPLPSQQLTLLQLLEFPSSLHDSTIPPHSGGRLLGLFPDSNALKNSS
SSNNETAIDFKASSDKVVAVEFDTYHNWDSWDPYYKHIGIDVNSIRSKATAQRNWQNGKI
ATAHISYNSASKRLTVVAFYPATKAVTLSHDIELNKVLPEWVRVGISASTGAHKQKNTIL
SWSFTSSLKNNGVQKKEDMYIASVA

FIG. 8A(35)

```
SEQ ID NO: 157
>UNIPROT:A0A4D6N5S7_VIGUN A0A4D6N5S7 (Lectin {ECO:0000313|EMBL:QCE08204.1})
MAISTTNYSVLIPMFVFVTTLFMFPSKVKSAQSLSFSFSRFGSDQKDLIFQGDAISTNNV
LQLTKLDSAGNPVSGSVGRVLYSAPVPIWENSAVVYSFESSFTYEISTPYTSPPADGLTF
FIAPYDTVIPPNSGGRLIGLFTDSNAFRNSSISKNQTTVDFKAESNKVVAVEMDTYSNDN
VGDPSYKHIGIDVNSIRSKTTARWDWQNGKTATAHISYNSASKRLTVATFYPGSSAVTLS
YDLELHTVLSKWVRVGFSASTGEQKQRNTILSWSFTSSLKNNEVKEEKQDILITTVV
```

FIG. 8A(36)

```
SEQ ID NO: 158
>UNIPROT:FRIL_LABPO Q9ZTA9 Flt3 receptor-interacting lectin
{ECO:0000303|PubMed:9892687} (Lectin alpha chain {ECO:0000303|PubMed:9892687}) (Lectin
beta chain {ECO:0000303|PubMed:9892687}) (Lectin alpha-1 chain
{ECO:0000303|PubMed:9892687}) (Precursor)
MFPSKVKSAQSLSFSFTKFDPNQEDLIFQGHATSTNNVLQVTKLDSAGNPVSSSAGRVLY
SAPLRLWEDSAVLTSFDTIINFEISTPYTSRIADGLAFFIAPPDSVISYHGGFLGLFPNA
NTLNNSSTSENQTTTKAASSNVVAVEFDTYLNPDYGDPNYIHIGIDVNSIRSKVTAKWDW
QNGKIATAHISYNSVSKRLSVTSYYAGSKPATLSYDIELHTVLPEWVRVGLSASTGQDKE
RNTVHSWSFTSSLWTNVAKKENENKYITRGVL
```

FIG. 8A(37)

```
SEQ ID NO: 159
>UNIPROT:A0A0R0HY71_SOYBN A0A0R0HY71 Lectin_legB domain-containing protein
{ECO:0000259|Pfam:PF00139}
MLFMLPNKVNSAHSVSFTFNKLGGDQKDLIFQGDATSNNNVLQLTKLDNKGNPVSGSQLT
LLQLLEFPSSLHDSTIPPHSCCRLLGLFPDSNALKNSSSSNNETAIDFKASSDKVVAVEF
DTYHNWDSWDPYYKHIGIDVNSIRSKATAQRNWQNGKIATAHISYNSASKRLTVVAFYPA
TKAVTLSHDIELNKVLPEWVRVGISASTGAHKQKNTILSWSFTSSLKNNGVQKKEDMYIA
SVA
```

FIG. 8A(38)

```
SEQ ID NO: 160
>UNIPROT:A0A060N4U6_9FABA A0A060N4U6 (Lectin-like protein
{ECO:0000313|EMBL:BAN37442.1})
MAFSKNKSLSLLPLLAFISMFLMLLKRVNSADSLSFSFKEFTADPEDLIFQGDTITGSNN
VLQLTKVDSSGNPVGQSVGRVLYYAPVHLWESSELVSSFETTFTFSISSSVINPGDGLAF
FIASPDTTIPSKSSGENLGLFPSSSALVAVEFDTYPNNNVGDPSYKHIGIDINSITSKTT
TKWNWQNGATATAQISYNSASKRLSVVASYPGTTPVTLSYDTDLLAILPQWVRVGFSAST
GQQMQSNTLHSWSFTSTLQTNNQIQNKDMHLASI
```

FIG. 8A(39)

```
SEQ ID NO: 161
>UNIPROT:LEC_LEUMI P42088 Lectin (Agglutinin) (BMA) (Lectin beta chain) (Lectin alpha
chain)
ANSVCFTFTDFESGQQDLIFQGDASVGSNKALQLTKVDSKGNPQGGSVGRALYTAPIRLW
QSSSLVASFETTFTFSISQGSSTPAAALTFFIASPDTKIPSGSGGRLLGLFGSSNNAGSD
NGVVAVEFDTYPNTDIGDPNYRHIGIDVNSIRSKAASKWDWQNGKTATAHISYNSASKRL
SVVSSYPNSSPVVVSFDVELNNVGPPDVRVGFSATTGQYTQTNNILAWSFRSSLMGYQAN
```

FIG. 8A(40)

SEQ ID NO: 162
>UNIPROT:A0A445BCR6_ARAHY A0A445BCR6 (Uncharacterized protein
{ECO:0000313|EMBL:RYR36470.1})
MKPFCVFLTFFLLLAASSKKVNSAETVSFNFNSFSEGNPAINFQGDVTVLSNGNIQLTNL
NKVNSVGRVLYAMPVRIWSSATGNVASFLTSFSFEMKDIKDYDPADGIIFFIAPEDTQIP
AGSIGGGTLGVSDTKGAGHFVGVEFDTYSNSEYNDPPTDHVGIDVNSVDSVKTVPWNSVS
GAVVQVTVIYDSSTKTLSVAVTNENGDITTIAQVVDLKAKLPERVKFGFSASGSLGGRQI
HLILASKKVNSASETETVSFSFNSFAQGNPAINLQGDATVHSDGNVQLTNLKNSYSAGRV
LYATPVRLWDKATGNVASFVTSFSFQMTDLEGYNAADGIIFFVAPEDTQIPSGGVGGTLG
VASSNGVGKFVGVEFDSYSNSEFKDPPYQHIGIDVNTLVSSKTVEWKRVSGSVVKVTVIY
DSPSKTLSVAVINESGDINTITEVVDLKAELPEKVKFGFSSASSVGGRQIHLIRSWSFIS
TLKTTTSISSNGKTMDIATA

FIG. 8A(41)

SEQ ID NO: 163
>UNIPROT:A0A0R0EBT5_SOYBN A0A0R0EBT5 Lectin_legB domain-containing protein
{ECO:0000259|Pfam:PF00139}
MGLWNTTNAVSCRFHKFGDDQKNLVFQGDATSSSRGIELTKLDGGGKPVGGSVGRVLYSS
PVHLWESSTVVASFETDFTFSISSDSTTPGDGLAFFIAPFDTKIPPNSGGSNLGLFPSDN
VVAVEFDTYPNRDKGDPDYRHIGIDVNSIVSKATARWEWQNGKIATVHISYNSASKRLTV
AAFYPGTQTVTLSHDIELNKVLPEWVRVGLSASTGQQKQTNTIHSWSLAFNNSIG

FIG. 8A(42)

SEQ ID NO: 164
>UNIPROT:A0A0B2R3Q1_GLYSO A0A0B2R3Q1 (Lectin {ECO:0000313|EMBL:KHN26653.1})
MGLWNTTNAVSCRFHKFGDDQKNLVFQGDATSSSRGIELTKLDGGGKPVGGSVGRVLYSS
PVHLWESSTVVASFETDFTFSISSDSTTPGDGLAFFIAPFDTKIPPNSGGSNLGLFPSDN
VVAVEFDTYPNRDKGDPDYRHIGIDVNSIVSKATARWEWQNGKIATVHISYNSASKRLTV
AAFYPGTQTVTLSHDIELNKVLPEWVRVGLSASTGQQKQTNTIHSWSLAFNNRIG

FIG. 8A(43)

SEQ ID NO: 165
>UNIPROT:A0A445BCW5_ARAHY A0A445BCW5 (Uncharacterized protein
{ECO:0000313|EMBL:RYR36471.1})
MKPFCVFLTFFLLLAASSKKVNSAETVSFNFNSFSEGNPAINFQGDVTVLSNGNIQLTNL
NKVNSVGRVLYAMPVRIWSSATGNVASFLTSFSFEMKDIKDYDPADGIIFFIAPEDTQIP
AGSIGGGTLGVSDTKGAGHFVGVEFDTYSNSEYNDPPTDHVGIDVNSVDSVKTVPWNSVS
GAVVQVTVIYDSSTKTLSVAVTNENGDITTIAQVVDLKAKLPERVKFGFSASGSLGGRQI
HLILASKKVNSASETETVSFSFNSFAQGNPAINLQGDATVLSDGNVQLTNLKNSYSAGRV
LYATPVRLWDKATGNVASFVTSFSFQLTDLEGYNAADGIIFFVAPEDTQIPSGGVGGTLG
VASSNGVGQFVGVEFDSYSNSEFKDPPYQHVGIDVNTLVSSKTVEWKRVSGSVVKVTVIY
DSPSKTLSVAVINESGDINTITEVVDLKAKLPEKTLSVAVINESGDINTITEVVDLKAEL
PEKVKFGFSSASSVGGRQIHLIRSWSFISTLKTTTSISSNGKTMDIATA

FIG. 8A(44)

SEQ ID NO: 166
>UNIPROT:A0A445CGB9_ARAHY A0A445CGB9 Lectin_legB domain-containing protein
{ECO:0000259|Pfam:PF00139}
MSSTSFTFNKFEFNNEKDLIFQGDASISKNNVLNLTKVDQNGLPLGTSVGRVLYSAPIHL
FSSSALASSFETTFTFRISSNNSNNVGDGLAFFIAAPETTIPFGSNGRLLGLFSGPYTTD
KVVAVEFDTYPNRDIGDPDFTHIGIDINTLKSSAVGKWSVQSGAIATAYISYDSVSKILS
VISSYPNAAPVTVTHAFDLDKTLPEWVRVFSGSTGLFSQTNDILSWSFRSTLTTNNIV

FIG. 8A(45)

```
SEQ ID NO: 167
>UNIPROT:A0A444Y9N0_ARAHY A0A444Y9N0 Lectin_legB domain-containing protein
{ECO:0000259|Pfam:PF00139}
MSSTSFTFNKFEFNNEKDLIFQGDASISKNNVLNLTKVDQNGLPLGTSVGRVLYSAPIHL
FSSSALASSFETTFTFRISSNNSNNVGDGLAFFIAAPETTIPPGSNGRLLGLFSGPYTTD
KVVAVEFDTYPNRDIGDPDFTHIGIDINTLKSSAVGKWSVQSGAIATAYISYDSVSKILS
VTCSYPNAAPVTVTHAFDLDKTLPEWVRVGFSGSTGLFSQTNDILSWSFRSTLTTNNIV
```

FIG. 8A(46)

```
SEQ ID NO: 168
>UNIPROT:V7BC16_PHAVU V7BC16 Lectin_legB domain-containing protein
{ECO:0000259|Pfam:PF00139}
MFFIMFPSKVNSAQSLSFNFTKFDLDQKDLIFQGDATSTNNVLQLTKLDSGGNPVGASVG
RVLFSAPFHLWENSMAVSSFETNLTIQISTPHPYYAADGFAFFLAPHDTVIPPNSWGKFL
GLYSNVFRNSPTSENQSFGDVNTDSRVVAVEFDTFPNANIDPNYRHIGIDVNSIKSKETA
RWEWQNGKTATARISYNSASKKLTVTTFYPGMEVVTLSHDVDLHAELPEWVRVGLSASTG
EEKQKNTIISWSFTSSLKNNEVKEPKEDMYIANVV
```

FIG. 8A(47)

```
SEQ ID NO: 169
>UNIPROT:LECA_LABPU P38662 Lectin (Lectin alpha chain) (Lectin beta chain)
AQSLSFSFTKFDPNQEDLIFQGTATSKLDSAGNPVSSSAGRVLYSAPLRLWEDSAVLTSF
DPTIYIFTNYTSRIADGLAFIAPPDSVISYHGGFLGLFPNAAESGIAESNVVAVEFDTDY
LNPDYGDPNYIHIGIDVNSIRSKVTASWDWQNGKIATAHISYNSVSKRLSVTTYYPGRGK
PATSYDIELHTVLPEWVRVGLSASTGQNIERNTVHSWSFTSSLWTNVAKVGVASISG
```

FIG. 8A(48)

```
SEQ ID NO: 170
>UNIPROT:V7BC49_PHAVU V7BC49 Lectin_legB domain-containing protein
{ECO:0000259|Pfam:PF00139}
MAISNNKPSFLIPQLVFVTMLLIMFPSEVNSAESLSFSFTKFGPDQKDLIFQGDATSTNN
VLQLTKLDNEGNPVSGSVGRVLYSGPFHLWENSAALSSFETTFTIQISTPYTSPPADGFA
FFLAPHDTVIPPNSGGSLLGLFSDLNAFKNSSTTSQNQTLFDVKAASNKVVAVEFDTYPN
ENVGDPRYRHIGIDVNSIRSKATARWEWYNGKTASARISYNSASKKLTVATFYPGIKALT
LSHDVDLHAELPEWVRVGFSASTGEQKERNTILSWSFKSSLEKNEVNEEKEDIYITSVV
```

FIG. 8A(49)

```
SEQ ID NO: 171
>UNIPROT:A0A0B2PM24_GLYSO A0A0B2PM24 (Agglutinin-1 {ECO:0000313|EMBL:KHN10471.1})
MAIWKTNKSLSLPLMAFTMATMFLMLLNRVNSADSLSFSFNNFSEDQEDLILQGDATTGA
SSENDKNVLQLTKLDDSGKPEFGSVGRVLYFAPVHLWKSSQLVSTFETTFTFKISSASPD
SVPADGLAFFIASPDTTPGAGGQDLGLFPHLTSLKNSSSSHHRKVTRITGVKDLASEPVV
AVEFDTFINTDIGDPEYQHIGIDINSITSVTTTKWDWQNGKTVTAQISYNSASKRLTVVA
SYPDSTPVSLYYDIDLFTILPEWVRVGFSASTGGAAEANTLLSWSFSSSLQTNQIQKEDM
HGIVM
```

FIG. 8A(50)

```
SEQ ID NO: 172
>UNIPROT:I1L3I1_SOYBN I1L3I1 Lectin_legB domain-containing protein
{ECO:0000259|Pfam:PF00139}
MAIWKTNKSLSLPLMAFTMATMFLMLLNRVNSADSLSFSFNNFSEDQEDLILQGDATTGA
SSENDKNVLQLTKLDDSGKPEFGSVGRVLYFAPVHLWKSSQLVSTFETTFTFKISSASPD
SVPADGLAFFIASPGTTPGAGGQDLGLFPHLTSLKNSSSSHHRKVTRITGVKDLASEPLV
AVEFDTFINTDIGDPEYQHIGIDINSITSVTTTKWDWQNGKTVTAQISYNSASKRLTVVA
SYPDSTPVSLYYDIDLFTILPEWVRVGFSASTGGAAEANTLLSWSFSSSLQTNQIQKEDM
HGIVM
```

FIG. 8A(51)

SEQ ID NO: 173
>UNIPROT:A0A444Y9I6_ARAHY A0A444Y9I6 Lectin_legB domain-containing protein
{ECO:0000259|Pfam:PF00139}
MSSVSFTFNKFEPNQEDLILQGDSSISNKNVLHLTNVDQNGLPQNGSVGRALYSAPIHIF
SKSALASSFETTFTFKVSQNGSNAPGDGFAFFIAPTDTTIPPNSGGKFLGLFDGPGIITD
TIVAVEFDTYVNREIEDPDFIHIGIDINSIKSSVTNKWILQSGVVATAKISYNSVSKRLS
VICSYPNAAPVTLTHDVDFSNAVPEWVRVGFSGSTGQYAQANDILSWSFRSTLTTNNIV

FIG. 8A(52)

SEQ ID NO: 174
>UNIPROT:A0A165TQ41_PHAVU A0A165TQ41 (Mannose lectin FRIL
{ECO:0000313|EMBL:AMY95822.1})
MEVSEKKYNFFPINREGFAWTYQDSNFIAFNTTMAISTNKPSFLIPLLVFVTMFFIMFPS
KVNSAQSLSFNFTKFDLDQKDLIFQGDATSTNNVLQLTKLDSGGNPVGASVGRVLFSAPF
HLWENSMAVSSFETNLTIQISTPHPYYAADGFAFFLAPHDTVIPPNSWGKFLGLYSNVFR
NSPTSENQSFGDVNTDSRVVAVEFDTFPNANIDPNYRHIGIDVNSIKSKETARWEWQNGK
TATARISYNSASKKLTVTTFYPGMEVVTLSHDVDLHAELPEWVRVGLSASTGEEKQKNTI
ISWSFTSSLKNNEVKEPKEDMYIANVV

FIG. 8A(53)

SEQ ID NO: 175
>UNIPROT:A0A4D6N351_VIGUN A0A4D6N351 (Legume lectin {ECO:0000313|EMBL:QCE08176.1})
MAISNKSYSFLIPLFVSVTMFFMFPGKVKSSQSLAFSFSKFGPDQKDLIFQGDAISTNNV
IQLTKLDSAGNPLRGSVGRVLHSSPMRLWENSTAVSSFESFFTFQISTPYTSPPADGLAF
FFAPYETVIPSNSAGSHLGLFSNNINNALRNSSTSRNQTTVGFKDVSNNVVNNVGNNVVA
VEFDTYPNPDIGDPANKHIGIDVNSITSKVTTRWDWQNGKTATAYISYNSAAKRLTVATF
YAGSNTVILSYDVELNTVLPQWVRVGFSGSTGGETQRNTILSWSFTSSLKNNEA

FIG. 8A(54)

SEQ ID NO: 176
>UNIPROT:A0A445CGD5_ARAHY A0A445CGD5 Lectin_legB domain-containing protein
{ECO:0000259|Pfam:PF00139}
MSSVSFTFNKFEPNQEDLILQGDSSISNKNVLHLTNVDQNGLPQNGSVGRALYSAPIHIF
SKSALASSFETTFTFKVSQNGSNAPGDGFAFFIAPTDTTIPPNSGGKFLGLFDGPGITTD
TIVAVEFDTYVNRDIEDPDFIHIGIDINSIKSSVTNRWIVQSGVVATAKISYNSVSKTLS
VICSYPNAAPVTLTHNVDLNNVLPEWVRVGFSGSTGQYAQANDILSWSFRSTLTTNNIGI
WVSFKLFTPVQQIMIQRYAGHFLTKSFIHLGAILGRSL

FIG. 8A(55)

SEQ ID NO: 177
>UNIPROT:C6SW99_SOYBN C6SW99 Lectin_legB domain-containing protein
{ECO:0000259|Pfam:PF00139}
MGLWNTTNAVSCRFHKFGDDQKNLVFQGDATSSSRGIELTKLDGGGKPVGGSVGRVLYSS
PVHLWESSTVVASFETDFTFSISSDSTTPGDGLAFFTAPFDTKIPPNSGGSNLGLFPSDN
VVAVEFDTCPNRDKGDPDYRHIGIDVNSIVSKATARWEWQNGKIATVHISYNSASKRLTV
AAFYPGTQTVTLSHDIELNKVPPEWVRVGLSASTGQQKQTNTIHSWSLAFNNSIG

FIG. 8A(56)

SEQ ID NO: 178
>UNIPROT:Q9M7M4_PHAVU Q9M7M4 (Mannose lectin FRIL {ECO:0000313|EMBL:AAF28739.1})
(Fragment)
AQSLSFNFTKFDLDQKDLIFQGDATSTNNVLQLTKLDSGGNPVGASVGRVLFSAPFHLWE
NSMAVSSFETNLTIQISTPHPYYAADGFAFFLAPHDTVIPPNSWGKFLGLYSNVFRNSPT
SENQSFGDVNTDSRVVAVEFDTFPNANIDPNYRHIGIDVNSIKSKETARWEWQNGKTATA
RISYNSASKKSTVTTFYPGMEVVALSHDVDLHAELPEWVRVGLSASTGEEKQKNTIISWS
FTSSLKNNEVKEPKEDMYIANVVRSYTWINDVLSYISNK

FIG. 8A(57)

SEQ ID NO: 179
>UNIPROT:A0A445DQ16_ARAHY A0A445DQ16 Protein kinase domain-containing protein
{ECO:0000259|PROSITE:PS50011}
MSLYKSKPVFLILIPLLMLHRNLRTSFEFSDFSSPYRNELFIFQGDASASSNGSIQLTKI
VNGKPIPNSVGRVSYGLPVRLWDLKTQKLASFTTSFSFLVSPNGGDGISFFMAPFHSPIP
KDSQGGYLGLFNPDASLAPFRDPTVAVEFDTFSNPWDPAFSHIGIDVNSIVSVTSVPWLN
GVEGLNTTVFATVSYEAVAQNLSVVVSYYSGSVLGGTTVNASLSHVIDLRNVLPERVSVG
FSGATGQFVEVNNILSWKFTSFTFPNFWSPTKDIVFEGDADYSNGGLTLTKIVNSAPIGN
SAGRASYSSPVRLWDANTGSLAAFTTTFSFTVEPFLYKPFGDGIAFFIAPFVSELPKNSS
GGYLGLFNADTALDSYKNQIVGVEFDSFSNAWDPNTAHIGIDVNSIASVTTTPWQPGNVA
SATLDFEPVNTNLSVSVRYVNGSSSSISFVIDLRTVLPEWVRVGFSESVSFNLDNFMPNL
YLIKFEGDAFVSEKVLQLTKNRIDGPITKSVGRASFDQPVKLWDKGTRQLTDFTTHFSFI
MKAINPNMFGDGLSFYIAPFESTIPNNSVGGFLGLFSGESAFNTTANQIVAVEFDSFENP
WDPNPNHVGINVNSIISVANVSWNRNMKNGSIANAWVSYNSTTKNLSVFLTYADNPTFNG
TFSLSHVIDLREFLPEFVRIGFSAATGDWIEIHNVLSWSFNSTLDSSTGKSKVGLASGLS
VGFGTLACLIGVICFVFWRKRRNRARKDEDDTGFDASIEDEFERGTGPKRFTQKELSQAT
NGFAEEGKLGEGGFGGVYKGAVGNPRMEVAVKRVSKGSKQGKKEYISEVRVISRLRHRNL
VQLIGWCHEKGEFLLVYEYMPNGSLDSHLFGKGVMLAWAVRYKIALGLASALVYLHEEWE
QCVVHRDIKSSNVMLDANFNAKLGDFGLARLVDHELGTQTTVLAGTMGYLAPECVTTGKS
SKESDVYSFGAVALEIACGRRPVQVKEEPGKVRLIEWVWNLYGQGKLLEAADWRLDLEFD
VKQMECLMTVGLWCCHPDYAMRPSIKQVINVLNFEAPLPSLPSQLPVPMYFAPPMEMCKF
TYTSSGTTATSKDSSNYSSMSAGSRKSLL

FIG. 8A(58)

SEQ ID NO: 180
>UNIPROT:A0A445J176_GLYSO A0A445J176 (Flt3 receptor-interacting lectin
{ECO:0000313|EMBL:RZB92141.1}) (2.7.7.7 {ECO:0000313|EMBL:RZB92141.1})
MAFTMATMFLMLLNRVNSADSLSFSFNNFSEDQEDLILQGDATTGASSENDKNVLQLTKL
DDSGKPEFGSVGRVLYFAPVHLWKSSQLVSTFETTFTFKISSASPDSVPADGLAFFIASP
DTTPGAGGQDLGLFPHLTSLKNSSSSHHRKVTRITGVKDLASEPVVAVEFDTFINTDIGD
PEYQHIGIDINSITSVTTTKWDWQNGKTVTAQISYNSASKRLTVVASYPDSTPVSLYYDI
DLFTILPEWVRVGFSASTGGAAEANTLLSWSFSSSLQTNQIQKEDMHGLYVRDMLSKVVP
ATFYTISSFSKLIWRSEQSSPKKSPIYSRSSTPPGKFTLVSTPVTLCRKACCLACYEILV
SYRKYFATYVETCFQKFGDRVKHWITFNEPHTFSTQGYDVGLQAPGGSPFSFTCSASKPY
IVAHNGGSLGVAFDVIWYEPLTNTKENNIDAAQKAQHFQLGCSSGGYIHLVVQREQGYIP
CGSLLVKVFTRLKEISRTGGCLGTGCRHSLGKFDAKAYEGIFLGYSLHSKAFRIYNKRTM
TIEESIHVSFDETNITSSREEFPDDITYSLEDMHYQERDLKRKRNGENKDAQDNIIQEND
DLPKEWRTSRNHHLDNIIGDISKGITTRLSLKDLCNNMTFVSLIEPKNLKEAIIDDHWIV
AIEFEMFMMGELNYFLGLQIKQTNDGIFVNQAKYCKELIKRFGMEKSKHLATPMSTSCYL
DQDESDQPVDAKQYRGYSDSDFAGSKTDRKSTSGTCQFIGSALVSWNSKKQNSVALSTTE
EEYISAALLPQIHRGFVVPRLNNFHETLHLSLEALLSSPTLFARLVSPSPPMFFSVSPTD
VATSLVFSAPFLILSAIVHATSLALSFVSKQVQVLKDQVSEKVLSSNLVDTIVHIKRPVI
LNYWQGSSSTL

FIG. 8A(59)

SEQ ID NO: 181
>UNIPROT:LEC2_CYMRO P86795 Lactose-binding lectin-2 (Lectin-II
{ECO:0000303|PubMed:18712290}) (CRLII {ECO:0000303|PubMed:18712290,
ECO:0000303|Ref.1})
SGAVHFSFTKFSTSSSDLTLQGSALVSSKGSLKKNPSKKGKPVDHSVGRALYRSPIHIWD
ETTGKVASFDATFSFVSEAPAIPMLFPSSKGELNDEDDTRIGGQLGVVNDSYNVIRVTVA
VENDGYRNRVDPSARPHISLPIKSVRSKKTAKWNMQTGKVGTAHISYNSVAKRLSAVVSY
TGNSSSTTVSYDVLLNLAVLPSKVLVGKTATGLYKDHVETNTILSWSFTSKLKTNSIAD

FIG. 8A(60)

SEQ ID NO: 182
>UNIPROT:P93537_STYJP P93537 (Lectin {ECO:0000313|EMBL:AAB51457.1})
MAISNTNFLQTKKPLFLPILAFITIFLMLLNRVNSSDSLSFTYENFQPNPEDLILQRDAS
ITSNETLLLTRTSNGKPQKGSVGRALYYAPVRLWDKSTGRLASFETSFSFVITSPTTDPG
DGIAFFIAPPDTTPGYTGGLLGLFNSSTVQSNSSDHGVAFHNSLPQIVAVEFDTYINGGR
DPNYRHVGIDVNSIKSVSTTKWTWRNGVEATANISYNPVSQRLTAVSSYPNSEPITVHYD
IDLKTVLPEWVRVGFSASTGENVEINSILSWSFSSSLQSLTAEKEDMYIARYV

FIG. 8A(61)

SEQ ID NO: 183
>UNIPROT:P93536_STYJP P93536 (Lectin {ECO:0000313|EMBL:AAB51442.1}) (Fragment)
LVFITFFLTLLNMVNSSDSLSFTFNNFGPDQRDLILQGDAHIPSGTLQLTKTDSSGVGRA
LYYLPVHLWDSRRGRLASFETSFSFVITSQGTDDPGDGIAFFIAPPETTIPPRSSGGFLG
LFSPETALNSSLNPVVAVEFDTFINEDWDPSYWHIGIDVNSIKSSAARWERKSGRKFTA
HISYNSSSKKLSVVSSYPNTNCLVRVDYTVSYDIDLTTVLPEWVRIGFSASTGYKIEEHS
ILSWSFSSSFQSSRAKKEDLYIARCA

FIG. 8A(62)

SEQ ID NO: 184
>UNIPROT:A0A6B9VCJ7_ARAHY A0A6B9VCJ7 (Agglutinin {ECO:0000313|EMBL:QHN78887.1})
MASNSKIPLYLPLLASMAIFLILLHSVNSVDVTTFLFDRFDQNNENLIIQGDASVSSNGA
LQLTRVDSSGVPQGGSVGRALYSEPISLYDKSTGAVASIFTSFIFLISSPSDTPGDGLTF
FLASPDTTIPPNSGGGYLGLFSASNALNNTRKELVGFKSTSDKVVAVEFDTYPNLNLGDP
DYKHIGIDVNSIKSEVTAEWDFQNGEPVAVTIFYDPYAKTLRVFASYPNGYNVDFTHDID
LTTVLPEQVRVGFSGATGQYSQINNIISWSFGSILGKSFKVEKGGIASVV

FIG. 8A(63)

SEQ ID NO: 185
>UNIPROT:A0A151U658_CAJCA A0A151U658 (Agglutinin-1 {ECO:0000313|EMBL:KYP74803.1})
MLLMAVNRVNSADSLSFSFNSFGLDQKDLIFQGDATALRNALQLTRLDSQLQPLPSSVGR
VLYSAPIQLVGAFETSFTFSISSPDTIPGDGLTFFIASHDTVIPPNSNGKVVAVEFDTYP
NLDIRDPNFVHIGINVNSITSARTAQWVWRNGLTATARINYNSLTKTLTAATFYPGTGTE
VVSISHAIDLSTVLPQWVRVGFSASTGQHKQKNSIHSWAFSTILKNSKIEEEEDTNIVSV
V

FIG. 8A(64)

SEQ ID NO: 186
>UNIPROT:A0A444XSQ1_ARAHY A0A444XSQ1 (Lectin {ECO:0000313|EMBL:QHN78911.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGIDVNSIRSSKVCYWNFHDAAITTAKITYNSAHKKL
TVHVSTYLHSQPDTLTYDVDLSTKLPEKVKIGISASTGQFSQTTEILSWIFKSN

FIG. 8A(65)

SEQ ID NO: 187
>UNIPROT:A0A444XTG2_ARAHY A0A444XTG2 (Lectin {ECO:0000313|EMBL:QHN78906.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASAETEIPPESSGKFLGLFNDAS
DRIVAVEFDTFSNSDIGDPNYPHIGVDVNSIRSSKVCYWNFHDAAITTAKITYNSAHKKL
TVHVSTYLHSQPDTLTYDVDLSTKLPEKVKIGISASTGQFSQTTEILSWIFKSN

FIG. 8A(66)

SEQ ID NO: 188
>UNIPROT:A0A444XTH8_ARAHY A0A444XTH8 (Lectin {ECO:0000313|EMBL:QHN78859.1})
MGVSFNLHKFDPKHSKEIQFQGDATITDHHIIRLTNLDDDGNPLGNRVGRVLFSDPVHLY
DHSGLRAGFETTFVFRISKPYNSEYTPGPGDGLAFFLASADTEIPPESSGKFLGLFNDAS
DRIVAVEFDTFSNSDIGDPNYPHIGVDVNSIRSSKVCYWNFHDAAITTAKITYNSAHKKL
TVHVSTYLHSQPDTLTYDVDLSTKLPEKVKIGISASTGQFSQTTEILSWIFKSN

FIG. 8A(67)

SEQ ID NO: 189
>UNIPROT:A0A444XTH2_ARAHY A0A444XTH2 (Lectin {ECO:0000313|EMBL:QHN78913.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGIDVNSIRSSKVCYWNFHDAAITTAKITYNSAYKKL
TVHVSTYLHSQPDTLTYDVDLSTKLPEKVKIGISASTGQFSQTTEILSWIFKSN

FIG. 8A(68)

SEQ ID NO: 190
>UNIPROT:A0A444XSQ2_ARAHY A0A444XSQ2 (Lectin {ECO:0000313|EMBL:QHN78905.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGVDVNSIRSSKVCYWNFHDAAITTAKITYNSAHKKL
TVHVSTYLHSQPDTLTYDVDLSTKLPEKVKIGISASTGQFSQTTEILSWIFKSN

FIG. 8A(69)

SEQ ID NO: 191
>UNIPROT:A0A444XST5_ARAHY A0A444XST5 (Uncharacterized protein
{ECO:0000313|EMBL:RYQ92772.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGIDVNSIRSSKVCYWNFHDAAITTAKITYNSAHKKL
TVHVSTYLHSQPDTLTYDVDLSTKLPEKVKIGISASTGQFSQTTEILSWIFKSSKVCYWN
FHDAAITTAKITYNSAHKKLTVHVSTYLHSQPDTLTYDVDLSTKLPEKVKIGISASTGQF
SQTTEILSWIFKSN

FIG. 8A(70)

SEQ ID NO: 192
>UNIPROT:A0A445BJ22_ARAHY A0A445BJ22 Lectin_legB domain-containing protein
{ECO:0000259|Pfam:PF00139}
MGVSFNLHKFAPTNSKEIKFQGDATITDHNVIRLTNLDSDGNPLGNRVGRVLFSDPVHLY
DHSGFRAGFETTFVFRISKPYSSEFAPGPGDGLAFFLANADTEIPPESSGKFLGLFNDAS
DKIVAVEFDTFSNFEIGDPSYPHIGININSIRSSAVGYWNWHDGAVTTAKITYNSVLKRI
TVSVSTYLDNQPNTLSYDVDLSTKLPQKVAVGLSASTGQYSQNTEILSWTFKSN

FIG. 8A(71)

SEQ ID NO: 193
>UNIPROT:LEC2_CLAKE Q39529 Agglutinin-2 (Agglutinin II) (ClAII) (LecClAII) (Precursor)
MAISNTNLLQTKKPISLPLLAFITLFLMLLNRVNSSDSLSFTFDNFRPDQRDLILQGDAK
ISSGGDSLQLTKTDTSGKPVRGSVGRALYYTPLHLWDSSTNRLASFQTTFTFVLSSPTNN
PGDGIAFFIAPPETTIPPGSSGGLLGLFSPDNALNNSLNQIVAVEFDTFVNNNWDPSHRH
IGIDVNTIKSSATVRWQRENGSLATAQISYNSDTKKLSVVSSYPNTQANEDYTVSYDVDL
KTELPEWVRVGFSGTGGYVQNHNILSWTFNSNLQSSRAKKEDIYIKRYV

FIG. 8A(72)

SEQ ID NO: 194
>UNIPROT:A0A444XSM1_ARAHY A0A444XSM1 (Lectin {ECO:0000313|EMBL:QHN78908.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGIDVNSIRSSKVCYWNFHDAAITTAKITYNSAHKKL
IVHVSTYLHSQPDTLTYDVDLSTKLPEKVKIGISASTGQFSQTTEILSWIFKSN

FIG. 8A(73)

```
SEQ ID NO: 195
>UNIPROT:A0A444XSL7_ARAHY A0A444XSL7 (Lectin {ECO:0000313|EMBL:QHN78907.1})
MGVSFNLHKFDPKHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGVDVNSIRSSKVCYWNFLDAVITTAKITYNSAHKKL
TVHVSTYLHSQPDTLTYDVDLSTKLPEKVKIGISASTGQFSQTTEILSWIFKSN
```

FIG. 8A(74)

```
SEQ ID NO: 196
>UNIPROT:A0A444XTI3_ARAHY A0A444XTI3 Lectin_legB domain-containing protein
{ECO:0000259|Pfam:PF00139}
MGVSFNLHKFDPKHSKEIQFQGDATITDHHIIRLTNLDDDGNPLGNRVGRVLFSDPVHLY
DHSGLRAGFETTFHSKEIQFQGDATITDHHIIRLTNLDDDGNPLGNRVGRVLFSDPVHLY
DHSGLRAGFETTFVFRISKPYNTEYTPGPGDGLAFFLASADTEIPPESSGKFLGLFNDAS
DRIVAVEFDTFSNSDIGDPNYPHIGIDVNSIRSSKVCYWNFHDAAITTAKITYNSAHKKL
TVHVSTYLHSQPDTLTYDVDLSTKLPEKVKIGISASTGQFSQTTEILSWIFKSN
```

FIG. 8A(75)

```
SEQ ID NO: 197
>UNIPROT:A0A6B9VBE1_ARAHY A0A6B9VBE1 (Lectin {ECO:0000313|EMBL:QHN78880.1})
MSPLSSSTGSIKVTNENLIIQGDTSFSSNGALQLTRVDSSGVPQGGSVGRALYSEPISLY
DKSTGRVASIFTSFIFLISSPSDTPGDGLTFFLASPDTTIPPNSGGGYLGLFSASNALNN
TRKELVGFKSTSDKVVAVEFDTYPNLNLGDPDYKHIGIDVNSIKSEVTAEWDFQNGEPVA
VTIFYDPNAKTLRVYASYRNGYNVDFTHDIDLTTVLPEQVRVGFSGATGQYSQINNIISW
SFGSILGKSFKVEKGGIASVV
```

FIG. 8A(76)

```
SEQ ID NO: 198
>UNIPROT:A0A445BIV4_ARAHY A0A445BIV4 Lectin_legB domain-containing protein
{ECO:0000259|Pfam:PF00139}
MGVSFNLHKFAPTNSKEIKFQGDATITDHNVIRLTNLDSDGNPLGNRVGRVLFSDPVHLY
DHSGFRAGFETTFVFRISKPYSSEFAPGPGDGLAFFLANADTEIPPESSGKFLGLFNDAS
DKIVAVEFDTFSNLEIGDPSYPHIGININSIRSSAVGYWNWHDGAVTTAKITYNSALKRI
TVSVSTYLDNQPNTLSYDVDLSTKLPQKVAVGLSASTGQYSQNTEILSWTFKSN
```

FIG. 8A(77)

```
SEQ ID NO: 199
>UNIPROT:A0A445BIU7_ARAHY A0A445BIU7 Lectin_legB domain-containing protein
{ECO:0000259|Pfam:PF00139}
MGVSFNLHKFAPTNSKEIKFQGDATITDHNVIRLTNLDSDGNPLGNRVGRVLFSDPVHLY
DHSGFRAGFETTFVFRISKPYSSEFAPGPGDGLAFFLANADTEIPPESSGKFLGLFNDAS
DKIVAVEFDTFSNFEIGDPSYPHIGININSIRSSAVGYWNWHDGAVTTAKITYNSALKRI
TVSVSTYLDNQPNTLSYDVDLSTKLPQKVAVGLSASTGQYSQNTEILSWTFKSN
```

FIG. 8A(78)

```
SEQ ID NO: 200
>UNIPROT:A0A445BIV1_ARAHY A0A445BIV1 Lectin_legB domain-containing protein
{ECO:0000259|Pfam:PF00139}
MGVSFNLHKFAPTNSKEIKFQGDATITDHNVIRLTNLDSDGNPLGNRVGRVLFSDPVHLY
DHSGFRAGFETTFVFRISKPYSSEFAPGPGDGLAFFLANADTEIPPESSGKFLGLFNDAS
DKIVAVEFDTFSNFEIGDPSYPHIGININSIRSSAVGYWNWHDGAVTTAKITYNSALKRI
AVSVSTYLDNQPNTLSYDVDLSTKLPQKVAVGLSASTGQYSQNTEILSWTFKSN
```

FIG. 8A(79)

SEQ ID NO: 201
>UNIPROT:A0A444XZ73_ARAHY A0A444XZ73 Lectin_legB domain-containing protein
{ECO:0000259|Pfam:PF00139}
MGVSFNLHKFVPNNSKEIKFQGDATITDHNVIRLTNLDSDGNPLGNRVGRVLFSDPVHLY
DHSGFRAGFETTFVFRISKPYNSEFAPGPGDGLAFFIANSNTEIPPESSGKFLGLFNDAS
DKIVAVEFDTFSNFEIGDPSYPHIGININSIRSSAVGYWNWHDGAVTTAKITYNSALKRI
TVSVSTYLDNQPDTLTYDVDLSTKLPEKVAVGLSASTGQYSQNTEILSWTFKSN

FIG. 8A(80)

SEQ ID NO: 202
>UNIPROT:LEC1_CLAKE Q39528 Agglutinin-1 (Agglutinin I) (ClAI) (LecClAI) (Agglutinin-1
subunit A) (Agglutinin-1 subunit B) (Precursor)
MTISNTNFLETKKPLSLPLLAFITIYLMLLHRVNSSDSLSFTFNNFPPNSEDLIFQKDAS
ISSNETLELTRISSSGQPATSSVGRALYYIPVRLWDKSTGRLASFKTTFSFAITSPTQDP
GDGFAFFIAPPDTTPGYGGGLLGLFNGFNLRNSSNNGVAVNNQSAQIVAVEFDTYINGQC
DPKYRHVGIDVNSITSLAYTQWQNGVKATAQISYNPASQKLTAVTSYPNSTPLTVSLD
IDLQTVLPEWVRVGFSASTGQNVERNSILAWSFSSSLTTLTAKKEDMYIARYV

FIG. 8A(81)

SEQ ID NO: 203
>UNIPROT:A0A445BCY4_ARAHY A0A445BCY4 Lectin_legB domain-containing protein
{ECO:0000259|Pfam:PF00139}
MGVSFNLHKFDPKHSKEIQFQGDATITDHHIIRLTNLDDEGNPLGNRVGRVLFSDPVHLY
DHSGFRAGFETIFVFRISKPYNTDYTPGPGDGLAFFLASADTEIPPQSSGMFLGLFNDAS
DKIVAVEFDTFSNSEVGDPNYPHIGVDINSIRSSKVCYWNFHDAAITTAKITYNSAHKKL
TVHVSTYLDTQPDTLTYDVDLSTKLPDKVKVGISASTGQFSQTTEILSWIFKSN

FIG. 8A(82)

SEQ ID NO: 204
>UNIPROT:A0A445BCU1_ARAHY A0A445BCU1 Lectin_legB domain-containing protein
{ECO:0000259|Pfam:PF00139}
MGVSFNLHKFDPKHSKEIQFQGDATITDHHIIRLTNLDDEGNPLGNRVGRVLFSDPVHLY
DHSGFRAGFETTFVFRISKPYNTDYTPGPGDGLAFFLASADTEIPPQSSGMFLGLFNDAS
DKIVAVEFDTFSNSEVGDPNYPHIGVDINSIRSSKVCYWNFHDAAITTAKITYNSAHKKL
TVHVSTYLHTQPDTLTYDVDLSTKLPDKVKVGISASTGQFSQTTEILSWIFKSN

FIG. 8A(83)

SEQ ID NO: 205
>UNIPROT:A0A445BCU3_ARAHY A0A445BCU3 Lectin_legB domain-containing protein
{ECO:0000259|Pfam:PF00139}
MGVSFNLHKFDPKHSKEIQFQGDATITDHHIIRLTNLDDEGNPLGNRVGRVLFSDPMHLY
DHSGFRAGFETIFVFRISKPYNTDYTPGPGDGLAFFLASADTEIPPQSSGMFLGLFNDAS
DKIVAVEFDTFSNSEVGDPNYPHIGVDINSIRSSKVCYWNFYDAAITTAKITYNSAHKKL
TVHVSTYLHNQPDTLTYDVDLSTKLPDKVKVGISASTGQFSQNTEILSWIFKSN

FIG. 8A(84)

SEQ ID NO: 206
>UNIPROT:Q2EN03_BAUUN Q2EN03 (Lectin {ECO:0000313|EMBL:ABD19775.1}) (Fragment)
LTQLNKVKSTNSTLTCFTPNFWSYSLENGTEITFLGGATYTPGALHLTRIAEDGFPMKR
DAGQASYSHPVFLWDSVGHEASFYTSFSFIVRNCDVPKITADGFAFFLAPVDSSVKGFGG
CLGLFTYGTAADPSKNQVVAVEFDTWPNTQWSDPSYPHIGIDVNSTVSVATKRSENADAY
GNKIGTAHITYDASSKIITVLLTYDNGTHYVLSHVVDLPKILPNWVRIGLSASNGYNETP
YILSWSFTSTLDSSKIRAA

FIG. 8A(85)

SEQ ID NO: 207
>UNIPROT:A0A445BCT8_ARAHY A0A445BCT8 Lectin_legB domain-containing protein
{ECO:0000259|Pfam:PF00139}
MGVSFNLHKFDPKHSKEIQFQGDATITDHHIIRLTNLDDEGNPLGNRVGRVLFSDPVHLY
DHSGFRAGFETTFVFRISKPYNTDYTPGPGDGLAFFLASADTEIPPQSSGMFLGLFNDAS
DKIVAVEFDTFSNSEVGDPNYPHIGVDINSIRSSKVCYWHFHDAAITTAKITYNSAHKKL
TVHVSTYLHTQPDTLTYDVDLSTKLPDKVKVGISASTGQFSQTTEILSWIFKSN

FIG. 8A(86)

SEQ ID NO: 208
>UNIPROT:A0A445BIW3_ARAHY A0A445BIW3 Lectin_legB domain-containing protein
{ECO:0000259|Pfam:PF00139}
MGVSFNLNKFVPNNSKDIIFQGDATITDHNVIRFTNLDSDGNPLGNRVGRILFSNTMHLY
DHSGFRAGFETTFIFRISKPYNSEFAPGPGDGLAFFITNAGTEIPPESSGKFLGLFNDAS
DKIVAIEFDTFSNFEIGDPNYPHIGVNINSIRSSAIGYWNWHDGAVTTAKITYNSALKRI
TVSISTYLDNQPDTLTYDIDLSTILPEKVVVGLSASTGQFSQNTEILSWTFKSN

FIG. 8A(87)

SEQ ID NO: 209
>UNIPROT:B2ZFI2_SOPFL B2ZFI2 (Lectin {ECO:0000313|EMBL:ACD13798.1})
MAIFQKHLSLPFLVFAIATIVLMSLRGVNSADSLSFTFSDFDPNGEDLLFQGDAHVTSNN
ILQLTKTSNGVPQQNSIGRALFSAPIHLWENSTNRLSSFESTFTFVLTSPQSNPADGFAF
FIAPPDTTIPEGSDGGLLGLFSPENALNPKANQVVAVEFDTFYDKSSNSWDPNYVHIGID
VNQIKSSATVRWDRKEGVIGTARINYNAATGNLSVVSSYPGSQDYVVSYIVDLRTKLPEW
VRVGFSASTGQQYQVHSIRSWFFNSVLLYTKAKNEDMYMASVV

FIG. 8A(88)

SEQ ID NO: 210
>UNIPROT:A0A445BIU9_ARAHY A0A445BIU9 Lectin_legB domain-containing protein
{ECO:0000259|Pfam:PF00139}
MRVSFNLHKFASTNSKEIKFLRAATITGHNVIRLTNLESNGNPLGNRVGRVLFSDPVHLY
DHSSFRTGFETTFVFHISKPYSSEFAPKPGDGLAFFLANADSEIPLESSRNFLDLFNDAS
AKVVAVEFDTFSNVEIGDPSGPHIGININSIRSSATSFWNWHDGAVTTAKITYNSALKRI
TVSVSTYLDNQPNTLSYDVDLSIKLPQKVAVGLSASTGQYSQNTEILSWTFKSN

FIG. 8A(89)

SEQ ID NO: 211
>UNIPROT:A0A4P1RE95_LUPAN A0A4P1RE95 Lectin_legB domain-containing protein
{ECO:0000259|Pfam:PF00139}
MAISKKPFLAFLFSTMLVMLVSFCSMVNASDSLSFTYGNFGQDEKDLIFQGDANVISTTN
VLQLTKTNGQGVPQQQTFGRALFSAPLRLWQKSTGRVSGFESTIKFVLTSPTTTPSDGFA
FFIAPIDTNIPIGTLGGYLGLFNSKTALNASASQVVAVEFDTFYGGDNIWDPNYTHIGIN
VNTIQSSAYVKWDRVEGAIGTAHIYYNSSTKNLTVVSSYPHGIVYTVSYVVDFKNVLPEW
VRVGISGASGGGVQLHTIKQWDFFSSLHYTNPNNNNIIMKKEKEDDIIIAPIVV

FIG. 8A(90)

SEQ ID NO: 212
>UNIPROT:A0A6A4NQX5_LUPAL A0A6A4NQX5 (Putative concanavalin A-like lectin/glucanase
domain, legume lectin {ECO:0000313|EMBL:KAE9588988.1})
MAISNIALVAFFTTIFFMLLSTVNSSDSLSFTFIDFDQNEEDLIFQGDAHVTSNRVLQLT
KTNSDGVAQQNSTGRVLYQDKIQLWENSTDRLSTFETIITFNLTSPTPNDPADGFTFFIA
PPETTIPHGSEGGLLGLFDLDPSKNQVVAVELDTFYRNPWDPTYDHIGIDVNTVNSSATV
KWDRKEGEIGTVCINYNAGTKNLSVVSSYPGSQTYSVSYVVDLRTVLPEWVRVGLSASTG
LQTQSHIIKSWFFYSTLDYVTAKKDEDIYIQHVV

FIG. 8A(91)

SEQ ID NO: 213
>UNIPROT:A0A6A5N8R7_LUPAL A0A6A5N8R7 Lectin_legB domain-containing protein
{ECO:0000259|Pfam:PF00139}
MLHTHLKVMAISNIALVAFFTTIFFMLLSTVNSSDSLSFTFIDFDQNEEDLIFQGDAHVT
SNRVLQLTKTNSDGVAQQNSTGRVLYQDKIQLWENSTDRLSTFETIITFNLTSPTPNDPA
DGFTFFIAPPETTIPHGSEGGLLGLFDLDPSKNQVVAVELDTFYRNPWDPTYDHIGIDVN
TVNSSATVKWDRKEGEIGTVCINYNAGTKNLSVVSSYPGSQTYSVSYVVDLRTVLPEWVR
VGLSASTGLQTQSHIIKSWFFYSTLDYVTAKKDEDIYIQHVV

FIG. 8A(92)

SEQ ID NO: 214
>UNIPROT:A0A444XPB0_ARAHY A0A444XPB0 (Lectin {ECO:0000313|EMBL:QHN77990.1})
MGVSFNLHKFVPNNSREIIFQGDATITDHNVIRLTNLDSDGNPLGNRVGRVLFSNTVHLY
DHSGFRAGFETTFIFRISKPYNSEFAPGPGDGLAFFITNAGTEIPPQSSGKFLGLFNDAS
DRIVAIEFDTFSNFEIGDPNYPHIGININSIKSSAIGYWNWHDGAVTTAKITYNSALKKI
TVSVSTYLDSQPDTLTYDIDLSTKLPEKVVVGLSASTGQFSQNTEILSWTFKSN

FIG. 8A(93)

SEQ ID NO: 215
>UNIPROT:B2LYE8_PHAVA B2LYE8 (Lectin I {ECO:0000313|EMBL:ACB87491.1})
MLLYNSKPYVLQLILITLLLTQLNKVKSTSSTLTSFTFPDFWSNSQENGTKIIFLGGATY
TPGALRLTRIAKDGFPMKSNAGQASYSHPVFLWDSTGHVASFYTSFSFIVRNCDVPKITA
DGFAFFLAPVDSSVKGFGGCLGLFTYGTAADPSKNQVVAVEFDTWPNTQWSDLSYRHIGI
DVNSIVSVATRRWENDDAYGNKIGTAHITYDATSKIITVLLTYDNGRHYQLSHVVDLPKI
LPKWVRIGFSAATGYNETQYILSWSFTSTLDSTKISALTQKLRSSASYSSM

FIG. 8A(94)

SEQ ID NO: 216
>UNIPROT:A0A6B9VDY4_ARAHY A0A6B9VDY4 (Alpha-methyl-mannoside-specific lectin
{ECO:0000313|EMBL:QHN78894.1})
MAISNTNLFLFSVPLLTFTIIFLMQLNKANSSDSLSFSFDNFNQEDGRNLIFQGDSTISP
TKNTLHITKVNSQATQLQTPLEDFVLKSPVSEPADGLTFFIAPSNTTVPGLSPGALLGIF
DAHSHLNPSLNQIVAVEFDTFSNYWDPSYPHIGIDVNTIQSVKTVQWERREGETVNVLVS
YTSRSRKLEVIASYSNGQRFEVSHVVDLRDVLPEWVRVGFSAATGAQYQSHEILSWSFTS
SLNYVQMEIK

FIG. 8A(95)

SEQ ID NO: 217
>UNIPROT:A0A444XSK8_ARAHY A0A444XSK8 Lectin_legB domain-containing protein
{ECO:0000259|Pfam:PF00139}
MAISNTNLFLFSVPLLTFTIIFLMQLNKANSSDSLSFSFDNFNQEDGRNLIFQGDSTISP
TKNTLHITKVNSQGNPAPNSLGRVLQSAELQLWDKATNRLSEFDCQFSFVLKSPVSEPAD
GLTFFIAPSNTTVPGLSPGALLGIFDAHSHLNPSLNQIVAVEFDTFSNYWDPSYPHIGID
VNTIQSVKTVQWERREGETVNVLVSYTSRSRKLEVIASYSNGQRFEVSHVVDLRDVLPEW
VRVGFSAATGAQYQSHEILSWSFTSSLNYVQMEIK

FIG. 8A(96)

SEQ ID NO: 218
>UNIPROT:A0A1J7HNI3_LUPAN A0A1J7HNI3 Lectin_legB domain-containing protein
{ECO:0000259|Pfam:PF00139}
MAISNIPLVPFFTIIFFILFSTVNSSDSLSFTFSDFNKDEKNLILQGDAHVTSNRVLQLT
KTNSTGVAQQYSIGRVLFHDKIQLWQKSPKRLSTFETTITFNLTSPTPNDPADGFTFFLA
PPKTTIPPGSDGGLLGLFDPNTALDPSKNQVVAVELDTFYFQNSNQWDPLYYHIGINVNT
INSSATVKWDRKEGGIGTVHINYNADTKNLSVVSSYLGSETYHVSYVVDLRNVLPEWVRI
GLSASTGQQTQVHIIKSWVFNSTLQHVKKEHGV

FIG. 8A(97)

SEQ ID NO: 219
>UNIPROT:LECB_SPAPA P86353 Seed lectin beta chain {ECO:0000303|Ref.1}
AEETSFVFSKFKPLEPNLILQGDALVTVAGVLQLTNVDSNGVPEPSSLGRATYSAPINIW
DSATGLVASFATSFRFTIYAPNIATIADGLAFFLAPVASAPDSGGGFLGLFDSAVGDTIY
QTVAVEFDTYENTVFTDPPYTHIGFDVNSISSIKTVKWSLANGEAAKVLITYNSAVKLLV
ASLVYPSSKTSFILADIVDLSSVLPEWVRVGFSAATGASKGYIETHDVFSWSFASKLAG

FIG. 8A(98)

SEQ ID NO: 220
>UNIPROT:Q8GU50_PTEAG Q8GU50 (Lectin {ECO:0000313|EMBL:CAD19806.1}) (Fragment)
MLLNKAYSQDSLSFGFPTFPSDQKNLIFQGDAQTKNNAVQLTKTDSNGNPVASTVGRILF
SAQVHLWEKSSSRVANFQSQFSFSLKSPLSNGADGIAFFIAPPDTTIPSGSGGGLLGLFA
PGTAQNTSANQVIAVEFDTFYAQDSNTWDPNYPHIGIDVNSIRSVKTVKWDRRDGQSLNV
LVTFNPSTRNLDVVATYSDGTRYEVSYEVDVRSVLPEWVGVGFSAASGEQYQTHTLESWS
FTSTLLYTAQKKGENLALEM

FIG. 8A(99)

SEQ ID NO: 221
>UNIPROT:Q8GS50_PTEAG Q8GS50 (Lectin {ECO:0000313|EMBL:CAD19804.1}) (Fragment)
MLLNKAYSQDSLSFGFPTFPSDQKNLIFQGDAQTKNNAVQLTKTDSNGNPVASTVGRILF
SAQVHLWEKSSSRVANFQSQFSFSLKSPLSNGADGIAFFIAPPDTTIPSGSGGGLLGLFA
PGTAQNTSANQVIAVEFDTFYAQDSNTWDPNYPHIGIDVNSIRSVKTVKWDRRDGQSLNV
LVTFNPSTRNLDVVATYSDGTRYEVSYEVDVRSVLPEWVGVGFSAASGEQYQTHTLESWS
FTSTLLYTAQKKGENLALEM

FIG. 8A(100)

SEQ ID NO: 1704
>UNIPROT:A0A662UGN2_9CREN A0A662UGN2 (D-ribose ABC transporter substrate-binding
protein {ECO:0000313|EMBL:RLG77775.1})
MRLSRIGASKTAAIVIVVVVIVAAIAGLAAYMSTVPPAPTTTTPTTTATTPTETAPTATT
AAPGKITLALFISNLGNPYFVMMKDGAVKAIEELKSKGVNIELKVYDAKDDPSLQVNQIE
TAVSEGVDAILVNPVHKEAIQPALEKAKDRGIPVVTTDRDVANPELRLVFIGTDNVKGGE
LAAKALIKALEESGKSKPWKIVILHGIPGTTAAEDRKKGFHNVLDSYIEKGDIEVVAEEI
ANFRRDEALSKMESLLAKTKDVDAVICANDEMALGAIQAIEGAGLTPGKDIIVVGYDAIP
DAVKAVKEGKMYATMAQSPFLQGYWAVYAAYYHIVKDWKPSADFIPTPLVVVTSENADTF
QEETAKPQPLPGAPSE

FIG. 9A(1)

SEQ ID NO: 1705
>UNIPROT:I3TF91_THEC1 I3TF91 (ABC-type sugar transport system, periplasmic component
{ECO:0000313|EMBL:AFK51429.1})
MGKALSKTITYVIIAIVVIAVAGGLAYWYYSSQKPSGIKVGLFISNLGNPYFALLRDGAQ
AAVNELKNKGVSIEMVVYDAKDDPSLQSNQIETAVGQKFSALVVNPTDIQAIQPSLSKAK
SAGIPVVTTDRDVADKTLRFVFIGTDNVKGAEQAANALIQALTESGKPTPWKVVILNGIP
GTTAAIDRNKGFHNVLDPLVSQGKVVIVAEEVANFRRDEALSKMESILAAKKVDAVIAAN
DEMALGAIQAIKGAGLTPGKDIIVVGYDAIPDAVAAVKAGEMYATIAQSPFLQGYWGILA
AYYRVTQNWNPPADWIPTPTVVVTKANADTFQQEVSTPKPLPGAP

FIG. 9A(2)

SEQ ID NO: 1706
>UNIPROT:A0A662UP11_9CREN A0A662UP11 (D-ribose ABC transporter substrate-binding
protein {ECO:0000313|EMBL:RLG80483.1})
MILVIIVVIAVVAAYYFFVAQQAGPGKISLALLISNLGNPYFVALRDGAQAAVNELKDKG
VDIEMEVYDAKDDPSLQSSQIETAVGKKVSAILINPVHAEAIQPALRKAIEAGIPVITTD
RDVADTSLRLVFIGTDNVAGAEAAAQALLQALEASGKPTPWKIVILNGIPGTTAAEDRKK
GFHNILDPLVGQGKIEIVAEEVANFRRDEALSKMESILAAHTVDAVIAANDEMALGAIQA
IEGAGLKPGDDIIVVGYDAIPDAVQAVKAEKMYATIAQSPFLQGYWAVYAAYYHIVNDWK
PSEDWIPTPTVVVTKDNADTFQAEVSSPKPLPGAPTS

FIG. 9A(3)

SEQ ID NO: 1707
>UNIPROT:A0A662VJ41_9EURY A0A662VJ41 (D-ribose ABC transporter substrate-binding
protein {ECO:0000313|EMBL:RLI74904.1})
MKYRKAVTKTVAIGIIIIVIAAAIGVAAYFLLAPPKAPEFDVALFISNLGNPYFVALKNG
SDAAVSELEQKGITVKLTVYDAKDDASLQTSQIETAVGQKVDAIVVNPVHKEAIQPALEK
ALEAGIPVVTTDRDVANKSLRICFTGTDNVEGGELAAKALIEALRASGKPTPWKVVILNG
IPGTTAAEERKTGFHNILDDFVDNGTVEIVAEEVANFRRDEGQSDMESILAAHPDVDAVI
CANDEMALGAILAIEGADLTPGEDIIVVGYDAIPDAVQAIKDGKMYATIAQSPFLQGYWG
VLIAYYYVFKNWQPEEDFIPTPLVVVTAENVDTFSEEVASPKPLPGAPSE

FIG. 9A(4)

SEQ ID NO: 1708
>UNIPROT:A0A662SCL8_9RCH A0A662SCL8 Peripla_BP_4 domain-containing protein
{ECO:0000259|Pfam:PF13407}
MAEKNESFLKKKISRRKALSTAAKAGISAIVAGVVAGIGGYYAGMSAVPTKEITKEVTKE
ITKTVTKTVTKTPTVTTTPTTPTTAVVITPTKKIRLGFAHVNLNCPYYLAMQRAAYDVAY
KFGWDIILTNAEADQVKQISDVESMLVKGIDALIINPVTEEGPKSVIKKCIEKDIPVVVV
DRTMYGDYIAYVGIDQWKAGRLQGEFIAKMLTEKYGEPKGFVALIGGEAGCPATIGRGGG
AIEVWKSKYPNIKYEWVGYGYYSMEKGMKIMEDAIATYGEKIDYVYAMNDAMALGALQAL
RAAGLTDVMVSGIDGQKEAYEEIMKGGQYKSTVVNHSWEITIVAMYLLMYYVEKGELPSE
EWLQSLKITTGPGGNIAKWKVIKEVRKVDKGPGGTTAYDVITGTELVTIENVALHYDPTA
IF

FIG. 9A(5)

SEQ ID NO: 1709
>UNIPROT:A0A151E919_9EURY A0A151E919 SpoVT-AbrB domain-containing protein
{ECO:0000259|SMART:SM00966}
MYRKVTRTGPATLTIALPAKWVKEHNLKPGQYVEVDESEADLIISPGIEKTPENIIIPYN
EVLIENMLEKLFLEAEATITIHSEEKIPETITKIVERFPGMQITEMQPNKVIISRTLKPA
LSNPDALLRRSYIVIKEALTHNPPQFSSNLNETFFLLQLHQKRPKEIFILKELYSTILKL
KKPVHDNTYALLRLVFNTVYEQKYNFSSTDTKHLAEIFGRTEDLFKNYYKKSKSPLQISE
VHYCIHLLSQLHKEILYKQSIDVLTKATKLTSKRFRVGVCLKNQSNPFWAIDVKESIRQT
AQGYKDMELIFKSPLKDFDINEQEEILKEFISEGMDGIMLAPIQPKRLKKIVDKINKLNI
PLLILDTDIELEENKYTFIGFDNYKGGYLTGEYLKKHLKKGSNVLILKGHLEGNFTQRVP
GFIDAMGKEYKTKVIVGHFQESTAYEKTLEYMKKNKVDAIFSTSDNMALGAIKAMEELNK
KIPICGFDMTEGGLAALKKGKLLSEVNTKPREQGALGAHTMYNLLTKKTVAERIEYDIEF
ITKKQLTR

FIG. 9A(6)

SEQ ID NO: 1710
>UNIPROT:A0A497F8K3_9CREN A0A497F8K3 (D-ribose ABC transporter substrate-binding
protein {ECO:0000313|EMBL:RLE55651.1})
MRTLGIAKKTLIGIVVAIIIIAVIAGVVASLYLAPAPGKKKLTFALLVSNLGNPYFVMLK
DGAEAAVKELKAKGIEVELIVYDAKDDPDLQVRQIEEAIAKKVDALLINPVHKEAILPAV
RDAVKAGIIVITTDRDIADKSLRVFFTGTDNVYGAELAVKALIEALEKSGKPKPWKIVIL
HGIPGTTAAEDRKKGFHNVLDPLVKKGDVKIVAEEIAYFRRDKGLEVMESILARTKEIDA
VICANDEMALGAIQAIEGAGLVPGKDIIVVGYDAIPDAVEAVKAGKMYATIAQSPFLQGY
WAVMGAYYIVVKGWKPPKDFIPTPVVVVTKANVGTFSEEVAKPKPLPGAPSE

FIG. 9A(7)

SEQ ID NO: 1711
>UNIPROT:A0A662VBH9_9CREN A0A662VBH9 Peripla_BP_4 domain-containing protein
{ECO:0000259|Pfam:PF13407}
MPAISAKTLAIFIVVLIAVAGIAAFVGYQYGLSVGGGAAAKKRYKIGLVLKTLTNPYFIE
MQKEFLRLSEKLGFEARVLSTATEQEVEKQVSMVEDLIAWGADAILITPDDSAGIVPAFK
ACREHGVICIAIDTPVEGDSPDNVVLADFFIGPDFVDAGEKVVDYVAKLLSPDDPSKAEG
KIAIFLGVPGAGSTILKLKGIRKGLSKYPGLEVVFNQTGMYERARGASLAEDLLSAHPDV
VVIISQNDLMALGALERLKALKRMDIIVTGMDAIPEACMSLLRGELKATINQRGADQVRE
AIYAAYKLLAGVELDKKWVDLPAELITKENVVMRIEKLKELGMWSS

FIG. 9A(8)

SEQ ID NO: 1712
>UNIPROT:A0A2G9MIR2_9RCH A0A2G9MIR2 Peripla_BP_4 domain-containing protein
{ECO:0000259|Pfam:PF13407}
MKQIFFICVLITFILVSGCVQQTPATTEESEEKMIVIGLSLSDMRVERWQTDRDFFIERA
EELGASVIAVSADLSADVQESQAENLILQGIDVLVIVANDGEKAAAIVEKANEAGIKVIA
YDRLIKNSDLDYYISFDNVKVGEYEAKGVLDVVSKGDFVYLGGSPTDNNAFLVKEGTFNL
LQPKIDSGDITLVLDVFNDGWKSEEAYRQLKAYLSENKKVDAVVCANDGTALGAIQALEE
FGLAGKVPVSGQDASLGACQMIAEGKQTVSVYKPIKTIAYKAAEMAVAIAKGETIETKQI
VNNGKVDVPSYLLDVEMVTKDTLMNTVIKDGFQSYDDIYQNIPENERPAKD

FIG. 9A(9)

SEQ ID NO: 1713
>UNIPROT:A0A3N6MKN4_9EURY A0A3N6MKN4 (Sugar ABC transporter substrate-binding protein
{ECO:0000313|EMBL:RQG96521.1})
MCGMYLVVCMVVGPSDNDHKYRRRKLLTLGSAVALGGLAGCVGDDDEDSDGSPVNGDESS
GNGGGSDNGDDDIMLIGFANKTLGVPFFARQEDGFHQAVETDLADHPSHLEASEIEGAGI
EVPSLDGSTFNAEMSESSQIDQLETFLSRDPDAVIINPVSPTGANPALEEYREEDIPVIN
IDTEITEFEPDTYIASRNIELGRRAGELLLEFLDDAYDKSSYNVVELQGAAGDVGTRERH
SGFREALEDSSVDVIGDEHADWAAQQALDAMEDMITRHGEDIDGVYAHNDFMAEGAYQAL
EGSDMGPLPTTSIDGSELWVTKFDEYEYYGSIAQQPENMTRLGIEKALMVANDIDIQDYY
PIPGIRVTSENAEDYLAEFFPDAEM

FIG. 9A(10)

SEQ ID NO: 1714
>UNIPROT:A0A2E0YB53_9EURY A0A2E0YB53 (Sugar ABC transporter substrate-binding protein
{ECO:0000313|EMBL:MAT85413.1})
MFMKNLLKFFAVFAFVFSTFVGSANAHSNKVYTIGFAAANLQADFFNFIKESVEAETARL
GHKSIVVDSGGDDAKQVSQIEDLITKQIDALVLIISGNTDGNAQIRKAKEAGIPVITVDR
NTTNPPGDSFVASDSEVASYQMGMWVAEQTGGKGVVGVIQGQLGSTPEIARDTGFENAIA
QFPDLNTVEKQASKMWSRDEGVSIAQDLLTRNPNITVLYGRCDALAQGAAQAAKAMGRDD
LLIVGFDGDRAALEDLKKGNTLLAATMIQQTLTIGRTATRFAIDAIEGRYIPPEVLYGST
LTTQENVEQFMGDGHP

FIG. 9A(11)

SEQ ID NO: 1715
>UNIPROT:A0A2R6KA32_9EURY A0A2R6KA32 Peripla_BP_4 domain-containing protein
{ECO:0000259|Pfam:PF13407}
MPTHTSRRSVLQGATAAGVVGLGGCLGLGSSGGDDAENQTALSVPTLEFTFFARMQNAFDD
AIDERDDLGGSFYDAGNSQEQQVSDLETPVSQGVDFIMVAPITAEGISPVVEQANEADIP
IVTIDRNIAEGDAATYVASDNVELGRRSMELCRGFMSDLSDADEYNVVELQGTQGASVTN
DRAEGASEAIDSADDLTLLDSQGADFSTEEAVSVMEDFITSHGDDIDGVYAHNDLMALGA
HQAVSNADIGDVATTGIDGSEAWVEEIQEVDHYGTLAQLPEEMVRQSIDYGLQAADGEDL
DDYYRIEGLEVTSENAGDYLDEYF

FIG. 9A(12)

SEQ ID NO: 1716
>UNIPROT:A0A1I2VDP1_9EURY A0A1I2VDP1 (Ribose transport system substrate-binding
protein {ECO:0000313|EMBL:SFG85536.1})
MSQNVRRRFIRTGVIAGTAMLAGCSGDGGDGDSETTAGGGSDGTETTDETDGTETTGGE
STPTVALSVPSLEFTFFARMENAFEQAQSDGLISSESSFYDASNNQSNQVSAVETAISNE
VDFLMISAITAEGVINAIQQANDADIPVVAIDRNISQGETVTYVASDNVQLGQRSTELCL
SFMEANGDGDSYDVVQLEGTPGASVTNDRGEGFQNAVSENDSLNQLATQTGEFSTQNALS
VMEDFITQYGDEIDGVFCQNDLMALGAHQALRNANMSVPVTGIDGTEAWVEQFSDNEYYG
TLAQLPEEMVTTAIESGKAHLAGEDVEDTITIEGLEVTQDNASDYLSDYFG

FIG. 9A(13)

SEQ ID NO: 1717
>UNIPROT:A0A2D6BXD2_9EURY A0A2D6BXD2 (ABC transporter substrate-binding protein
{ECO:0000313|EMBL:MAE98324.1})
MFASAAGITSAAVVGPLGINPALAGSHGGWSMAWSYRDRASAYWNAIVSGGEAYVESLGM
ASSDMVNLINEGSSEKSLADIKAFLAKNGGKGAIACDANDSPNARPVVEAVREAGGYIST
IWNKTDDLHPWDIGDNYVAHLSWSGEKPSADAARLLFDEMGGKGGVVHIGGIPANIPAIE
RLDGLKAALKDYPDVELLDVQSADWDTTKAAEVMSSLLTRYGDEIKGVHCANDNMAYGVI
EALKAEGITDMPITAFDGNPEAVDLVMKGDLLATVFTNPHWGGGIALALAHQAAIGAFKP
SEESNAHREFYGPSILVTPKDAAEFKATYLDSTPKYDWNDRWGLSAGQIQYK

FIG. 9A(14)

SEQ ID NO: 1718
>UNIPROT:A0A2I8VEM6_9EURY A0A2I8VEM6 Peripla_BP_4 domain-containing protein
{ECO:0000259|Pfam:PF13407}
MSRDVHRRQFVRSSLVAGTALVAGCAGGGGDEGDGAATEGGDGGGTSTEGDGAMTESGDG
TETASGDGTETSGGGSTPRVALSVPSLEFTFFARMENAFEQAKSEGLIASDSSFYDSGNS
QSAQVSDVETAISNDVDFLMISAITAEGVINAIQQANDAGIPVVAIDRNVAQGETVTYVA
SDNVQLGRRSTELCLSFMQDNADADTYDVVQLEGTPGASVTNERGEGFQNAVSENDSLNR
LASQTGEFSTQNALSVMEDFITQYGDEIDGVFCQNDLMALGAHQALQNADMSVPVTGIDG
TQAWVELFSDNQYYGTIAQLPEEMVTTAIDRGKAHLAGEDVQDTIVIEGLEVTQDNASDY
LSQYFG

FIG. 9A(15)

SEQ ID NO: 1719
>UNIPROT:A0A2I0NZP8_9EURY A0A2I0NZP8 Peripla_BP_4 domain-containing protein
{ECO:0000259|Pfam:PF13407}
MSLLIWSLKSSFFLLPPQYIHMVLYRSLLLMSLCSVLILITPSVLAESDNTGIELTHLSN
FSIGIIPSGNTSPFHQELLASANKSAWDRGWTTQILTPDTEENITFQKMAMETLIRDNAS
IICLNTLDPSALSSEISAADAVGIPIFLYNTLSPVKDMNITGYIGYNQYTGAAEMGSYAA
RLLADKKNEALETVQGRVFILRGLPGFHADERTAGFIAGLSQSPGIRIVGEEVAGWDRET
ARQIAIKALTADHGIDIFYGNSDEMAIGAALAAIEKGKEVNKDIFILGIDGNTPTLEMIR
NGTVTATLGVYPDLMGTTIIDQIEAVEMGRRVARYLGTPVIVVDSANLDEYINHSTWTDP
KESDLEKGH

FIG. 9A(16)

SEQ ID NO: 1720
>UNIPROT:M0JM03_9EURY M0JM03 (Periplasmic binding protein/LacI transcriptional
regulator {ECO:0000313|EMBL:EMA10016.1})
MSRDICRRTFIRSGALAGTALLAGCGGNGEDGSGGGDDGQADGDGGGQQSTSGNSAPSAA
LSVPSLEITFFARMENAFNEAKNQGTIASDSAFYDAGNSQSTQISDIETAISNEVDFIMV
SAITAEGVINAIQEANEADIPVVAIDRNVAEGDTVSYIASDNVQLGQRSTELCLSFMQDQ
GDQDSYNVVQLEGTPGASVTNERGEGFQNAVSNNDSLNQLATQTGEFSTQNALSVMEDFI
TQYGDEIDGVFCQNDLMALGAHQALQNAGMSVPVTGIDGTEAWVQRFSDNEYYGTLAQLP
EDMVNTSIERAQAHINGKDVEDSVVIEGLEVTQKNASDYLSQYFG

FIG. 9A(17)

SEQ ID NO: 1721
>UNIPROT:A0A2E8JFR5_9EURY A0A2E8JFR5 (Sugar ABC transporter substrate-binding protein
{ECO:0000313|EMBL:MBQ65103.1})
MKRNRFLSVVVSVLTLSLISCGDKNSSAGSGELGNGETDTAFTGSVFKGAGEFIPCEHYF
FADAEKDPNRESFAGASSDEATKPEESKGTVGMTCMNLNNPFFQLIAQEMEKAASAAGYT
LKAMDGKGDAALQNTQIDEFITQKCDAIFLNPADSKATGSGVRAAHDAGIPVFTFDIQME
DPEVQKLVTYHVGSDNYQGGRLAGESMMKATGGIGKIGIINLPEANSCKKRVDGFKDYLM
ENNSKLEIVTELNGKGDRVKGAEVAADMLAAHGDLVGIFGINDPCALGAWASVKEAGKLE
QITIIGFDGSPDGKIGVFEKKLYDTPMQFPGQMATKTVEAFLRYVAGDEL

FIG. 9A(18)

SEQ ID NO: 1722
>UNIPROT:A0A662N0K0_9EURY A0A662N0K0 (Sugar ABC transporter substrate-binding protein
{ECO:0000313|EMBL:RLF77927.1})
MRRHFIFAVGILMLVLIGVVFAEGFDIAVLLPGTVEFFSVERRGMDKAAEEFGLNLIYAD
AEWDAGKQLAQVENFIARNVDLILLCAADNLALRTAVTRCNEAGIPIIAFTNTIGTDPYG
RYPGIVSYVGRSDLEAGIVLGKIAESIFEDESETVDIVLIEGNPGTAPQRMREEGFMQVA
DKHPNWNIVDKRPIDGWTKEGALAFMEAFLQSGRHADLVACQWWSGAIAAAMALKEKGID
DVYVIGLEFAKEIIPYIESGEVYATTYFSVVEEGYKAVETAYKYLSGEEVPEYVLIEQTI
VTKDNLKNFEPEM

FIG. 9A(19)

SEQ ID NO: 1723
>UNIPROT:A0A2R6IH20_9EURY A0A2R6IH20 Peripla_BP_4 domain-containing protein
{ECO:0000259|Pfam:PF13407}
MRDVTTRRDLLRSGAIAGTALLAGCGGDGDGDGDGGDGGNGGADGDGGDGGDGADGDTPTE
TATPMSEGPMTTALSVPSLEFTFFARMQNAFDAAIEEGTISQESSFSGANNNSSQQVSDL
ETAITNEVDFIMVSAIREDAVVSTVEDAVDQGIPVVAIDRNVASDAIATYVASDNVSLGE
RSTELLLQFMADQESKDTYNVVELQGTTGASVTNDRGEGFGNVVDENAIEVLGSQTGEFA
TQAALNVMEDFITQHGDDIDGAFCHNDLMALGVHQAVQGSDIGPIPITGIDGTEGWVELF
GDNQYYGTIAQLPEEMVNTAIERGQTAVEGESLEDYYQVDGLEVTQDNASDYLDEYF

FIG. 9A(20)

SEQ ID NO: 1724
>UNIPROT:A0A6G8T8Z2_9EURY A0A6G8T8Z2 (Substrate-binding domain-containing protein
{ECO:0000313|EMBL:QIO22853.1})
MPRDIPRRRFIRTSAIAGTALIAGCGGDGGDGGDGGGDGATGTTETTGDGGDGDGDGGTE
TEETTQSTDAPSVALSVPSLEFTFFARMQNAFDAAKSEGTIASDSTFYDAGNSQSTQVSD
VETAISNEVDLLLISAITAEGVISAIQQANDAGIPVVAIDRNVAEGDTVSYVASDNVQLG
RRSTELCLSFMQEMEQKDTYNVLQLEGTPGASVTNDRGEGFSNAVSNNDSLSRLASQTGE
FSTQNALSVMEDFITQYGDEIDGVFCQNDLMALGAHRALQNANMSVPVTGIDGTEAWVQL
FSDNQYYGTIAQLPEEMVNTAIETGKAHLAGEDVQETVVIDGLEVTQDNAADYLGQYFG

FIG. 9A(21)

SEQ ID NO: 1725
>UNIPROT:A0A2R6DJN6_9EURY A0A2R6DJN6 Peripla_BP_4 domain-containing protein
{ECO:0000259|Pfam:PF13407}
MSRDLRRRQFIRSGTIAGAAVLAGCTGGGSDGGGNGSSGGNNASESGNGDDSSASNGSSA
NESGGSSSNSESPPTVALSIPSLEFTFFARMQEVFEQAKNQGTIASDSSFYDAGDSQSTQ
ISNVETAISNDVAFLMISAITAEGVVNAINEANQNDIPVIAIDRNVAEGETVTYIASDNV
QLGQRSTELCLNFMQESADMDTYSVVQLSGTPGASVTNERGQGFRNVVSNNSNLEALASQ
TGEFTIQDALSTMEDFITQYGDEIDGVFCQNDLMALGARQALQSSNMSVPITGIDGTRAW
VELFADNQYYGTLAQLPEEMVTTAIERGKAYLAGEEVEDVIPIDGLEVTQENAADYIDQY
FG

FIG. 9A(22)

```
SEQ ID NO: 1726
>UNIPROT:A0A1D2RAG1_9RCH A0A1D2RAG1 Peripla_BP_4 domain-containing protein
{ECO:0000259|Pfam:PF13407}
MKKSRIFFVLLTVLFMLFSLQVVWAEGKKEEKPYFAFVTNGVNDFWILSQRGLEQAAKDF
DVICDYRTPPNGTAAEQTSIVEDLLAKRVDGIAITIIDPDTMTPFLNEAAKKTFLITHDS
DAPESDRICYIGTNNYSAGRTMGKLIKEVIPNGGELMLQVGKLDVLNAVERRQGIIDELK
GLPVPEKYTVSPPGRVECEKWTILDTRIDNVDYGRAKQNAEDAIIRYPDIDLFVGLWAYE
GPMILSALKDAGLEGKIPVCAFDELGETLQGITDGYIYGTVVQDPYNFGYKSVEMLYALY
KGDRSMVPDDGIIYIPERVISKDNVKPFWDDMNKKLGK
```

FIG. 9A(23)

```
SEQ ID NO: 1727
>UNIPROT:A0A2V2NCG9_9EURY A0A2V2NCG9 Peripla_BP_4 domain-containing protein
{ECO:0000259|Pfam:PF13407}
MSVRYSISALFTCILVLLIIPAICPGETPVNQNSTEQTILGLIPSGNTSPFHQELIKGVI
DEAANHNWTVITIPPDSEENITSQKLAMWDLINRNARIICLNTLNTSALTPEIKAATEAG
IPVVLYNTLTPAQKMNISEYIGYNQYTGSAELGSYASRILAEKKNEAPDTIQGKVFILRG
LPGFHADQRTAGFITGLTQSHGITIADQKVAGWDRDTAKTIALQALKDHPDLSIFYGNND
EMAIGAAMAVLDRGKKVNSDLLCIGIDGNTPTLDMIRNGTMTATLGVYPYKMGSTVVKQA
VKILNGEQVPMYLETPSTVVDINNLDAYLNGSTWTDPIESVAEKEIK
```

FIG. 9A(24)

```
SEQ ID NO: 1728
>UNIPROT:A0A1D2QZ05_9RCH A0A1D2QZ05 (ABC transporter substrate-binding protein
{ECO:0000313|EMBL:ODS36523.1})
MNNTKRGKFLVGSILVGSVLLTLLASPTPTLAKSYVFAWIPKALNNPVFALGRDGAFKKA
SELTEKGPDNVDVIYTGSVASDAAEQVRVMEDIIAKGVDGIGISVNDPTALEDVINKAVA
AGIPVMTWDSDSPESKRFTYLGVNNHEGGKAAADLLVRAMGKKGKVALLTGVPGALNLEE
RIRGFKEGIKKYPGIEIVTTVACYDDINKGVEVVEEAMLANPDLNGWFFVGLWPLFAEKG
SMPIWGKAAKSGVTKTIAFDTLPVELEYMKDGYLVGLVGQKYWGWGYDTIQILYDHVAKG
KKFPDWVDSGMDIVTKRNVDAMAEAWRTHDFTKPLPPPFPK
```

FIG. 9A(25)

```
SEQ ID NO: 1729
>UNIPROT:A0A2R6K1K7_9EURY A0A2R6K1K7 Peripla_BP_4 domain-containing protein
{ECO:0000259|Pfam:PF13407}
MADDSTSTVSRRTALKALGTSGAVALAGCLGGGSGSEQTDSGGGGNGSGGGANSSGGGG
GESDSGGGGSGGEQPNYPHTIWGMYGSWEDAYVQGGKFFARDKGFEFENYNSRGEGQEQ
ISQIQSFVQQGADGIAVGPVSATAPASAIENAASQDIPVISCNSDIETPDLSMSIYIGNE
PATQAVGEAIVKQLRSDGSGNSAEGTVLDLQGDLAQSIGASREQGFRNAVNGVSGIEVLE
ARANFNQGPAQEGTFAQLQSTGGNIDAIFAANGAMAAGAAEALDRYGSQPGDVFMGCMDG
SPTVIDLFDEGWLQRGYAQPTQYYLPIALHYLDLLRTEGEGALPSPGDELTTDDLSISGQ
QHLGTDIWSGQDWAPATVREKNGHPWFQTSGKLLNSDNYDQSSNWGVIFSQDAV
```

FIG. 9A(26)

```
SEQ ID NO: 1730
>UNIPROT:A0A2R6HLD4_9EURY A0A2R6HLD4 Peripla_BP_4 domain-containing protein
{ECO:0000259|Pfam:PF13407}
MTSRRKLLKGIGAASTITLAGCSGDGDGSGDDGDSSTDTADKSGDQGTTVGDSDGSSDDG
QHFGISMKSMGQAGLFVQGLAGKWYTQDMDDVEITILDAQFDASKQTQDAINLINQGIDG
LLLNPYDANASAQIAEKAAEEDVPVMNFDTATLSNDIKLGALFGQYRGGEVAAERFTDMM
DEQGMDSAKVITSVFNFSSSTSQQRLYGFTENVPDGVEVVSRVESNGTAEDTAPKMQNAL
QANPDVDAIYSNNVGSGMGALQALDQFGQYYKKDHEDHVMSFGIDGGPELNQRIKSGYYD
FAVDQPLHMYAPLTLELMWDYLEGGDDALPQVGDVTPGEDLSLENKEVFGVKPWEEQFW
GPAEMVEYEADDETWWPWMKCAHAMITEDNADASYLYGNVARAYEDQN
```

FIG. 9A(27)

SEQ ID NO: 1731
>UNIPROT:A0A2I8VLK3_9EURY A0A2I8VLK3 Peripla_BP_4 domain-containing protein
{ECO:0000259|Pfam:PF13407}
MTSRRNLLKGIGAAGIAGLAGCTGGQSGNQSSGGGSSGGGGSSGGDGGSSEGTTVGDSG
SSDSGTQRFAVSMKSMGQAGLFVQGQAAKWYTRDRDDVEIVILDAEFDASKQTQDAINAI
NQGLDGILLNPFDAKASRQIVEKATEEDIPVMNFDTATLSEDVVMGALFGQYAGGQVAGE
RFTQMIEEQGIEDPKVITSVFNFESTTSQARLYGFTENIPDSVEVVNRIESDGTPEDSAP
QTQSALQANPDVDAIYSNNVGSGMGALTALQQMDMYHKKDSEDHVMAFGIDGGPELNQRI
GSGYYDFAVDQPLHMYAPLTLELMWDYLENGESALPQVGDTVTPGENLSIENKTVEGIEP
WSEQFWGPAEMTEYEAEDTAWWPWLKCQHAMITQENADASYLYGNVYREIEGSN

FIG. 9A(28)

SEQ ID NO: 1732
>UNIPROT:A0A133UA57_9EURY A0A133UA57 Peripla_BP_4 domain-containing protein
{ECO:0000259|Pfam:PF13407}
MDVAPTVDGEEIESETVEVESGETKDVEFTVTKEEAGNYTVSVHGRTTILEVTAEALEEL
LIGHSPLFTRDEFFRTLVRATQYYCQAHEGISQNWMNPHNTSAQQIKDMKYMIQQGVDGI
IASPISASACASVVDTAYSQNIPTVTYNTDAPTKNVAATVMVNNETLGAAAAEALIEKMK
KAGVELEGTAVIDGGDKTWPQAQARTRGFEKVFEEYPGLEIVKYWNEGWDMKKAKDKMTQ
YLIAHGKPLIAVGVNNTTNSGVIEALRAQDALVPRSQPNEHVWTAFIGLNSVVQEAMKNG
YAEISSNQPNLIYGTLALYLVERCIRNGPTPLADPGDVPEPGDTVIADPSKPIGEIEEGT
WNLALPKPTVLSGVDIAKQKWTPCPVVEKDGHPWIVTEPLVVEWDKAYTAPVYVNLAPKW
LE

FIG. 9A(29)

SEQ ID NO: 1733
>UNIPROT:A0A2R6HTH6_9EURY A0A2R6HTH6 Peripla_BP_4 domain-containing protein
{ECO:0000259|Pfam:PF13407} (Fragment)
GADGGDGGDGGDGDGGGDGDDGGDDTPTETATSEGPTTTALSVPSLEFTFFARMQNAFDA
AKEGGIISEDSSFYGANDNSSQQVSDLETAITNEVDFIMVSAIREDAVVSTVEDAVDQGI
PVVAIDRNVASDTIATYVASDNVSLGERSTELLLQFMADQESKDTYNVVELQGTTGASVT
NDRGEGFGNVVDENAVEVLGSQTGEFATQTALNVMEDFITQHGDDIDGAFCHNDLMALGV
HQAVQGSDIGPIPITGIDGTEGWVELFGDNQYYSTIAQLPEEMVNTAIERGQTAVEGESL
EDYYRIDGLEVTQDNATDYLDEYF

FIG. 9A(30)

SEQ ID NO: 1734
>UNIPROT:U3AEU4_9EURY U3AEU4 (Ribose ABC transporter, periplasmic ribose-binding
protein RbsB {ECO:0000313|EMBL:GAD53298.1})
MVTTLQNDQWQAFANGVQEAANALGAPDSDYKQNQGQQQKMVSQLSTAFTKGYNAICGTP
YQASGVPTVVRKCKQNDAGFVDFWNIAKWYTPLDAGENFIQYQIPAVAKTGQLTAEILFE
EMGGEGNFVHITGPHGVTGRNRNIGVENAMKKYPDINKLGMQPGDWSRPSGRKVMSSFVS
KYGDKIDGVYCQNDAMGLGAYTILKNNDMSVPMVGYDGPKDAVNNIKSTSADGDGPNWVA
SFSAKTFWQGGYAVVEAFDWLNGWRPTVPERMMWGGGVVVTSDPSKYRGKLKTEFDASWS
KPDDYLSVAYSDGKSPYDWKKMSRTLNPDGWDPQNKLVPIRKDEFNQLNWTESNKPSGYS
LPDAYSESGTFDDVEQRYAKHHETDPYQ

FIG. 9A(31)

SEQ ID NO: 1735
>UNIPROT:A0A0A2W209_BEABA A0A0A2W209 (D-galactose-binding periplasmic protein
{ECO:0000313|EMBL:KGQ13943.1})
MNKKVLTLSAVMSCMLFGAAANAADRIGVTIIYKYDDNFMSVVRKAIEKDAKASPDVQLLM
NDSQNDQSKQNDQIDVLLAKGVKALAINLVDPAAAGTVIEKARAQNVPVVFFNKEPSRKA
LDSYDKAYYVGTDSKESGIIQGDLIAKHWAANPAWDLNKDGQIQFVLLKGEPGHPDAEAR
TTYVIKELNDKGLKTQQLQLDTAMWDTAQAKDKMDAWLSGPNANKIEVVIANNDAMAMGA
VEALKAHNKTSIPVFGVDALPEALALVKSGAMAGTVLNDANNQAKATFDLAKNLADGKPA
AEGTNWKIENKIVRVPYYGVDKDNLAQFIGK

FIG. 9A(32)

SEQ ID NO: 1736
>UNIPROT:A0A4Q4XJN2_9PEZI A0A4Q4XJN2 Peripla_BP_4 domain-containing protein
{ECO:0000259|Pfam:PF13407}
MISRVLNTLAAAAVLTFAATSAHASKEAPVIGFSIDDLRVERWTHDRDYFVESAKKLGAT
VNVQSANANEAKQIAQIENLIAQNVDVLVIVPFNSKVLGNAIASAKKKGIKVVSYDRLIL
NADIDGYVTFDNVKVGELQAQGVVKLAPKGNYFLLGGAATDNNARLLREGQMKVLKPYVD
KGDIKIVGEQWTPEWDPSKAQNIVENALTANNNNIQGIVASNDGTAGGAIQALARQKLAG
KVPVSGQDADLAAVKRVAEGTQAMTVYKPIKQIAATAAEMAVDLVKGTAPKFNTKLNNGK
KDVDTVLLTPTLLTKDNLDSTVVKDGFYTHQQIFGK

FIG. 9A(33)

SEQ ID NO: 1737
>UNIPROT:A0A4V1XPH5_9PEZI A0A4V1XPH5 Peripla_BP_4 domain-containing protein
{ECO:0000259|Pfam:PF13407}
MISRVLNTLAAAAVLTFAATSAHASKEAPVIGFSIDDLRVERWPHDRDYFVESAKKLGAT
VNVQSANANEAKQIAQIENLIAQNVDVLVIVPFNSKVLGNAIASAKKKGIKVVSYDRLIL
NADIDGYVTFDNVKVGELQAQGVVKLAPKGNYFLLGGAATDNNARLLREGQMKVLKPYVD
KGDIKIVGEQWTPEWDPSKAQNIVENALTANNNNIQGIVASNDGTAGGAIQALARQKLAG
KVPVSGQDADLAAVKRVAEGTQAMTVYKPIKQIAATAAEMAVDLVKGTAPKFNTKLNNGK
KDVDTVLLTPTLLTKDNLDSTVVKDGFYTHQQIFGK

FIG. 9A(34)

SEQ ID NO: 1738
>UNIPROT:A0A0A2W0V0_BEABA A0A0A2W0V0 {D-ribose-binding periplasmic protein
{ECO:0000313|EMBL:KGQ13533.1})
MKKLILAALIALTTAPALAENEQIVFSTPNLAMPFEVHMQRTAVQAAKEMGVKLQVLDSQ
GSSPKQVADLENAITRGAQGFIVSPNDVNAVSSAVGEIQDAKLPVVTLDRSVASDKPVPH
FGANNYKGGQAVADFVKAKFPDGADIVLLTGQPGSSSNIERTKGIRDGLKAGGDKYKIVA
DQTGNWMRSEGMRIVESVLPSLPKKPQVILSANDDMALGAIEALQGQGMKPGEVLVTGFD
AVPEALARVRDGWMAATADQRPGFAVKTAMSQLVANIREKKAITGADYAPTMITKDNLDQ
AERIGEAGK

FIG. 9A(35)

SEQ ID NO: 1739
>UNIPROT:A0A0A2WKV1_BEABA A0A0A2WKV1 {ABC transporter periplasmic-binding protein yphF
{ECO:0000313|EMBL:KGQ13694.1})
MSRLTRKSFFAVLMLLSASSASLAAGKEITVGAIYLDTQGYYAGVRQGVQDAAKSSDVKV
QLIETNAQGDISKESSFVDTLVARNVDAIILSAVSENGSTRTIRRASEAGIPVICYNTCI
NQKGVETYISAYLVGDPLEFGKKLGNAAADYFIAHNIAAPKIAIINCEAFEVCVQRRKGF
EEALKARVPGMQIVANQEGTVLDKAISVGEKLIVSSQNLDAIMGESGGATLGAVKAVRNQ
NKVGKIAVFGSDMTTEIAQELQNNQVLKAVVDISGKKMGNAVFAQTVDVINKNPPKEKIT
QVPIDLYSKAEDGKQWLATHVDGLP

FIG. 9A(36)

SEQ ID NO: 1740
>UNIPROT:A0A0A2VT88_BEABA A0A0A2VT88 (Ribose transport system permease protein rbsC
{ECO:0000313|EMBL:KGQ11106.1})
MQTVGILPILVLIIAVFGFVAPNFFTESNLLNIARQSSINIVLAAGMTFIILTGGIDLSV
GSILGTTAVTAMVVSLMPGWEGLSIPAALLMGTGLGLFNGMLVAWAGLPPFIVTLGTYTA
LRGAAYLLADGTTVINSNINFEWIGNAYLGPVPWLVVIALLVIAVCWFILRRTTLGVHIY
AVGGNMQAARLTGIKVWMVLLFVYGMSGLLSGLGGIMSASRLYSANGNLGVGYELDAIAA
VILGGTSFVGGIGTITGTLVGALIIATLNNVTALLAGAMIAGAPFAQAKELKSIGVTVGD
LANPFFVQITKGAELEARKLAGDNVKVTLVSSGYDLGQQVAQIDNFIAAKVDMIILNAAD
SKGIGPAVKRAKDAGIVVVAVDVAADGADATITSDNTQAGQMACKYISDRLKDKGNVVII
NGPPVSAVQNRVEGCETEFKKHPDIKILSSNQNAKGSREGGLEVMTSLLAANPKIDGVFA
INDPTAIGADLAAKQAQRNEFFIVGVDGSPDGEEALKRGGSSLFVATPAQDPQVMAAKAV
EIGYDILQGKPAPKGPVLIPVTMIDKSNIGSYKGWTVNWQEVFDLKLGWDITDFGGSDFL
TMGLTLFTLRNGSPEGTPYAKSYAEKVMHVRDNQMTPMHFHWSKQEDIINRGGGNLIVEL
WHSDPFEQPDEADITVVIDGCRQTHAAGSQLRLSPGESISLVPEMYHSFWGEPGYGDVLV
GEHPYRRCRPGSAFVP

FIG. 9A(37)

SEQ ID NO: 1741
>UNIPROT:A0A4Q4XE05_9PEZI A0A4Q4XE05 Peripla_BP_4 domain-containing protein
{ECO:0000259|Pfam:PF13407}
MRSNQRRCVLRAAVCGAVLASLSMTVPLAHASKAHPEIGFCIDDLRVERWSRDRDYFVAA
AEKLGAKVSVQSADASEQRQISQIENLISRGVDVIVIVPFNSKALTNVVAEAKKAGIKVV
SYDRLILDADVDAYISFDNEKVGELQAQGVFNVRPKGNYFLLGGAPTDNNAKMLRQGQLK
VLQPAIDRGDIKVVGSQWVPEWSASAALGIVENALTANNNKIDAVVASNDGTAGGAIQAL
AAQKLAGKVPVSGQDADLAAVKRVIAGTQTMTVYKPLKLIATEAAQLSVALAKGDKPKYN
AQYDYGKKKVDTVLLQPTQLTKDNVNLVVKDGFYTQAQIGGQ

FIG. 9A(38)

SEQ ID NO: 1742
>UNIPROT:A0A0A2W3Y0_BEABA A0A0A2W3Y0 (D-ribose-binding protein
{ECO:0000313|EMBL:KGQ13372.1})
MLASIGFISAAGAAAPTYALVQINQQALFFNLMNKGAADAAKSSGKNLVIFNSNDNPVAQ
NDAIENYIQQGVKGILVDAIDVNGIMPAIKEAAAANIPVIAIDAVLPAGPQAAQVGVDYI
EGGKIIGKYFVDYVQKEMGGQARLGIVGALNSAIQNQRQKGFEEMLKSNPKITIADVVDG
QNVQDKAMIAAENLITGNPDLTVIYATGEPALLGAIAAVENQGRQKDIKVFGWDLTAKAI
SGIDGGYVTAVLQQDPEKMGAEALKALNAITSGKTVPKTILVPATVVTKANVDTYRSLFK

FIG. 9A(39)

SEQ ID NO: 1743
>UNIPROT:A0A0A2W3K5_BEABA A0A0A2W3K5 (D-xylose-binding periplasmic protein
{ECO:0000313|EMBL:KGQ13040.1})
MGGSPVDNNAKLFRAGQMKVLKPYIDEGKIKVVGDQWVDGWLPENALKIMENALTANNNK
IDAVVASNDATAGGAIQALSAQGLAGKVAISGQDADLAGIKRIIAGTQTMTVYKPITKLA
DTAAEIAVELGEGKQPAADATLNNGLKDVPSRLLTPIEVEKTNIDSTVIADGFHKKSDL

FIG. 9A(40)

SEQ ID NO: 1744
>UNIPROT:B9TFQ3_RICCO B9TFQ3 (D-galactose-binding periplasmic protein, putative
{ECO:0000313|EMBL:EEF25310.1}) (3.6.3.17 {ECO:0000313|EMBL:EEF25310.1}) (Fragment)
MLKLLTTSAVALVLASQAHAADRIGVSMGTLSNNFQTLIVNGMEDYAKSIGVELQIEDAT
TDVNKQLDQVKNFAAGGVSAIIVDPVDSDGTPALSKVAEDAGIPLIYVNVQPTDLNTLGK
QQAFVGSNENESGTLQTKEVCRMLGGKGNVVIMIGDLTSQAARQRTQDVYDVVKTPECSG
INVAQEQVGNWSRVNGADLVSNWLTSGVEFDAIIANNDEMALGAISALKAAGASTDKIIV
SGIDATPEALQAMKTGDLK

FIG. 9A(41)

SEQ ID NO: 1745
>UNIPROT:A0A0K9QDR9_SPIOL A0A0K9QDR9 Peripla_BP_4 domain-containing protein
{ECO:0000259|Pfam:PF13407}
MNSFAKLLAGTAVLVSLHTAAIAADLVVGVSWSNFQEERWKTDEAAIKAALDKAGAKYIS
ADAQSSAAKQLTDVESLISQGANALIILAQDSDAIGPAVEKAVAEGIPVVGYDRLIENQN
AFYITFDNKEVGRLQAAEVFKVKPEGNYVFIKGSSSDPNADFLFAGQQEVLKAAIDGGKI
KNVGEAYTDGWKPENAQKNMEQFLTKNNNKVDAVVASNDTAGGAIAALAAQGMAGSVPV
SGQDADFAALNRVALGTQTVSVWKDSRELGKEAAGIALELAGGKKMTEIKGVTSFDGGPK
KVAMQSVFLKPIAITKDNLGTVIDAGWIKKETACQGVKAGTVKACD

FIG. 9A(42)

SEQ ID NO: 1746
>UNIPROT:A0A0J8BFR0_BETVU A0A0J8BFR0 Peripla_BP_4 domain-containing protein
{ECO:0000259|Pfam:PF13407} (Fragment)
MPTKSSARWIADGDNMVKVLKDRGYKTDLQYAEDDIPNQLAQIENMITKGAKVLVIASID
GTTLSKALQNAADKGVKVIAYDRLIKGSKNVDYYATFDNFQVGVLQATSIVDKLGLKQGK
GPFNIELFGGSPDDNNAFFFYDGAMSVLQPYIDSGKLVVRSKQTGMNKVGTLRWDGSVAQ
ARMDNLLSAYYGKDKVHAVLSPYDGISIGILSSLKGVGYCTAQQPCPVVSGQDAEVPSIK
SILKGEQSSTVFKDTRELAKVAANMVDAVLTGKQPEINDTKTYNNGVKVVPSYLLKPVAV
DSSNWNAVLVGSGYYKESQIKCVPAWQLQRPDPVRRAGARIRGHPRQRAPGHHHSPGAG
AGAAAVDCR

FIG. 9A(43)

INDICATOR COMPOUNDS, DEVICES COMPRISING INDICATOR COMPOUNDS, AND METHODS OF MAKING AND USING THE SAME

CROSS-REFERENCE TO RELATED APPLICATIONS

The present application claims priority benefit to U.S. Provisional Application No. 63/019,126, entitled "INDICATOR COMPOUNDS, DEVICES COMPRISING INDICATOR COMPOUNDS, AND METHODS OF MAKING AND USING THE SAME," filed May 1, 2020, and U.S. Provisional Application No. 62/926,323, entitled "INDICATOR COMPOUNDS AND METHODS OF MAKING AND USING THE SAME," filed Oct. 25, 2019, each of which is hereby incorporated herein by reference in its entirety.

REFERENCE TO SEQUENCE LISTING

A Sequence Listing submitted as an ASCII text file via EFS-Web is hereby incorporated by reference in accordance with 35 U.S.C. § 1.52(e). The name of the ASCII text file for the Sequence Listing is CERCA161A ST25.TXT, the date of creation of the ASCII text file is Nov. 20, 2020, and the size of the ASCII text file is 4.42 MB.

Field

The present disclosure generally relates to compounds, compositions, devices comprising such compounds and compositions, methods of making any of the foregoing, and methods of using the same for the detection of analytes. In some embodiments, the analyte is glucose. Some embodiments pertain to methods of using those compounds, compositions, and/or devices to diagnose and/or monitor the blood sugar of diabetic patients.

BACKGROUND

Description of the Related Art

Identifying and understanding the risk factors associated with diabetes is important for the development and evaluation of effective intervention strategies. Lacking normal regulatory mechanisms, diabetics are encouraged to strive for glucose control through a modulated lifestyle approach that focuses on dietary control, exercise, and glucose self-testing with the timely administration of insulin or oral hypoglycemic medications. Invasive forms of self-testing may be painful and are often resisted by most diabetics.

SUMMARY

In some embodiments, indicator compounds and devices comprising the same are disclosed. In some embodiments, the indicator compound is a fusion protein. In some embodiments, the indicator compound is or comprises an analyte binding compound (e.g., a analyte binding protein) and/or comprises an analyte binding domain (e.g., a binding domain of an analyte binding protein). In some embodiments, the analyte is a sugar. In some embodiments, the analyte is glucose.

Some embodiments pertain to a device for detecting the presence of an analyte in a subject. In some embodiments, the device comprises a light transmissive material. In some embodiments, the light transmissive material is configured to receive an excitation wavelength of light from a light source. In some embodiments, the device comprises a waveguide. In some embodiments, the waveguide comprises a cladding layer that surrounds a core material. In some embodiments, the waveguide is configured to receive the excitation wavelength of light via a proximal end of the waveguide. In some embodiments, the waveguide is configured to transmit the excitation wavelength of light along the waveguide to a distal end of the waveguide. In some embodiments, the device comprises an indicator compound. In some embodiments, the indicator compound comprises a fusion protein. In some embodiments, the indicator compound is disposed within the waveguide. In some embodiments, the indicator compound is configured to receive the excitation wavelength. In some embodiments, the fusion protein comprises a luminescent protein domain and/or an analyte binding protein domain. In some embodiments, when the analyte binds to the analyte binding protein domain, the indicator compound undergoes a conformational change from a first conformation to a second conformation. In some embodiments, when in the second conformation, the indicator compound is configured to receive the excitation wavelength and to emit a luminescent signal. In some embodiments, the luminescent signal is received by the waveguide and transmitted to the light transmissive material. In some embodiments, the light transmissive material is configured to deliver the luminescent signal to a luminescence detector.

In some embodiments, the device further comprises an adhesive layer that adheres the device to skin of the subject. In some embodiments, the distal end of the waveguide is configured to penetrate the skin of the subject. In some embodiments, the distal end of the waveguide resides in the dermis of the subject.

In some embodiments, the waveguide further comprises a protective polymer layer over the cladding layer.

In some embodiments, the indicator compound is distributed in the core of the waveguide, at the interface of the core and the cladding layer of the waveguide, in the cladding layer of the waveguide, at the surface of the cladding layer of the waveguide, or combinations of any of the foregoing.

In some embodiments, the luminescent protein is a split luminescent protein. In some embodiments, the indicator compound shares 80% to 100% identity, homology, or similarity to one or more of SEQ ID NOs: 3-13 or 16-20. In some embodiments, the analyte binding protein domain is a domain of a periplasmic protein. In some embodiments, the analyte binding domain shares 80% to 100% identity, homology, or similarity to one of SEQ ID NOs: 2, 15, 122-221, or 824-1746. In some embodiments, a contiguous 100 amino acid portion of the analyte binding domain shares 80% to 100% identity, homology, or similarity to a contiguous 100 amino acid portion of one of SEQ ID NOs: 2, 15, 122-221, or 824-1746.

In some embodiments, the luminescent protein domain is a domain of a fluorescent protein. In some embodiments, the luminescent protein domain shares 80% to 100% identity, homology, or similarity to one or more of SEQ ID NOs: 1, 14, 34-121, or 222-823. In some embodiments, a contiguous 100 amino acid portion of the luminescent protein domain shares 80% to 100% identity, homology, or similarity to a contiguous 100 amino acid portion of one of SEQ ID NOs: 1, 14, 34-121, or 222-823.

Some embodiments pertain to a device for detecting the presence of glucose in a subject. In some embodiments, the device comprises a light transmissive material matrix material configured to receive an excitation wavelength of light from a light source. In some embodiments, the device comprises an indicator compound comprising a split fusion protein. In some embodiments, the indicator compound is disposed within the matrix material. In some embodiments, the indicator compound is configured to receive the excitation wavelength. In some embodiments, the fusion protein comprises a luminescent protein domain and/or a glucose binding protein domain. In some embodiments, when glucose binds to the glucose binding protein domain, the indicator compound undergoes a conformational change from a first conformation to a second conformation. In some embodiments, when in the second conformation, the indicator compound is configured to receive the excitation wavelength and to emit a luminescent signal. In some embodiments, the luminescent signal is transmitted through the light transmissive material to a luminescence detector.

In some embodiments, the device comprises the luminescence detector. In some embodiments, the device is configured to be implanted beneath the surface of the skin.

In some embodiments, the matrix material is part of a waveguide. In some embodiments, the indicator compound is distributed in a core of the waveguide, at an interface of the core and a cladding layer of the waveguide, in the cladding layer of the waveguide, at the surface of the cladding layer of the waveguide, or combinations of any of the foregoing.

In some embodiments, the luminescent protein is a split luminescent protein. In some embodiments, the glucose binding protein domain is a domain of a periplasmic protein. In some embodiments, the glucose binding domain shares 80% to 100% identity, homology, or similarity to one of SEQ ID NOs: 2, 15, 122-221, or 1703-1746. In some embodiments, a contiguous 100 amino acid portion of the glucose binding domain shares 80% to 100% identity, homology, or similarity to a contiguous 100 amino acid portion of one of SEQ ID NOs: 2, 15, 122-221, or 1703-1746.

In some embodiments, the luminescent protein domain is a domain of a fluorescent protein. In some embodiments, the luminescent protein domain shares 80% to 100% identity, homology, or similarity to one or more of SEQ ID NOs: 1, 14, 34-121, or 222-823. In some embodiments, a contiguous 100 amino acid portion of the luminescent protein domain shares 80% to 100% identity, homology, or similarity to a contiguous 100 amino acid portion of one of SEQ ID NOs: 1, 14, 34-121, or 222-823.

In some embodiments, the indicator compound shares 80% to 100% identity, homology, or similarity to one or more of SEQ ID NOs: 3-13 or 16-20.

Some embodiments pertain to a system for detecting an analyte in a patient. In some embodiments, the system comprises a light emitting device that provides the light source. In some embodiments, the system comprises the luminescence detector. In some embodiments, the luminescence detector is part of the light emitting device. In some embodiments, the system data received by the luminescence detector is transmitted to a handheld device. In some embodiments, the system comprises the handheld device.

Some embodiments pertain to an indicator compound. In some embodiments, the indicator compound comprises a luminescent protein domain. In some embodiments, the indicator compound comprises an analyte binding protein domain. In some embodiments, the indicator compound is configured to bind an analyte via the binding protein domain. In some embodiments, the indicator compound is configured to undergo a conformational change from a first conformation to a second conformation when the analyte is bound by the analyte binding protein domain. In some embodiments, when in the second conformation, the indicator compound is configured to receive the excitation wavelength and to emit a luminescent signal.

In some embodiments, the indicator compound comprises a contiguous 100 amino acid portion of the analyte binding domain shares 80% to 100% identity, homology, or similarity to a contiguous 100 amino acid portion of one of SEQ ID NOs: 2, 15, 122-221, or 824-1746.

In some embodiments, a contiguous 100 amino acid portion of the luminescent protein domain shares 80% to 100% identity, homology, or similarity to a contiguous 100 amino acid portion of one of SEQ ID NOs: 1, 14, 34-121, or 222-823.

In some embodiments, the indicator compound comprises a luminescent protein that is a split luminescent protein. In some embodiments, the luminescent protein domain is a fluorescent protein domain.

In some embodiments, the analyte binding domain shares 80% to 100% identity, homology, or similarity to one of SEQ ID NOs: 2, 15, 122-221, or 824-1746. In some embodiments, the analyte binding protein domain is a periplasmic protein sugar binding domain.

In some embodiments, the luminescent protein domain shares 80% to 100% identity, homology, or similarity to one or more of SEQ ID NOs: 1, 14, 34-121, or 222-823. In some embodiments, the luminescent protein domain shares 80% to 100% identity, homology, or similarity to one or more of SEQ ID NOS: 3-13 and 16-20.

In some embodiments, the indicator compound is encoded by DNA that shares 80% to 100% identity, homology, or similarity to one or more of SEQ ID NOS: 21-33.

Some embodiments pertain to a composition suitable for administration to a human comprising an indicator compound as disclosed anywhere herein.

Some embodiments pertain to a method of manufacturing an indicator compound as disclosed anywhere herein. In some embodiments, the method comprises expressing the indicator compound encoded by a vector in a recombinant host cell, and isolating the compound from the recombinant host cell. In some embodiments, the vector comprises a nucleic acid sequence encoding the luminescent protein and/or one or more luminescing fragments of a luminescent protein. In some embodiments, the vector comprises a nucleic acid sequence encoding the sugar binding protein and/or sugar binding portion of a sugar binding protein.

In some embodiments, the vector further comprises a signal sequence. In some embodiments, the recombinant host cell is selected from an insect cell, a fungal cell, a bacterial cell, an animal cell, and a transgenic animal cell. In some embodiments, the recombinant host cell is an *E. coli* cell, a CHO cell, a HEK293 cell, etc.

Some embodiments pertain to a method for detecting glucose in a patient. In some embodiments, the method comprises administering an indicator compound as disclosed anywhere herein to the patient and/or administering a composition comprising the compound to the patient. In some embodiments, the method comprises quantifying a glucose level in the patient based on a change in luminescence of the indicator compound.

In some embodiments, the indicator compound is administered to the patient using a cell. In some embodiments, the cell is autologous to the patient. In some embodiments, the cell comprises DNA having a region that encodes the indicator compound. In some embodiments, the cell is part of a skin graft received by the patient. In some embodiments, the cell is a keratinocyte, melanocyte, Langerhans cell, Merkel cell, immune cell, macrophage, epithelial cell, or red blood cell.

In some embodiments, the patient is human.

In some embodiments, the method comprises illuminating the indicator compound with light having a first maximum wavelength and detecting an emission of light at a second maximum wavelength.

Some embodiments pertain to a method for detecting an analyte in a patient. In some embodiments, the method comprises selecting a patient in need of analyte monitoring. In some embodiments, the method comprises inserting into or attaching a device as disclosed anywhere herein to the patient. In some embodiments, the method comprises applying the excitation wavelength of light to the indicator compound. In some embodiments, the method comprises collecting the luminescent signal from the device. In some embodiments, the method comprises comparing the luminescent signal to a reference signal indicative of a indicator compound without an analyte bound. In some embodiments, the method comprises quantifying an amount of luminescent signal as a concentration of analyte.

In some embodiments, the analyte binding domain of the analyte binding compound comprises, consists essentially of, or consists of a sugar binding protein, a sugar binding portion or fragment of a sugar binding protein and/or mimetic of a sugar binding protein or portion or fragment thereof. In some embodiments, the sugar binding protein, sugar binding portion or fragment of the sugar binding protein and/or mimetic of the sugar binding protein or portion or fragment thereof binds to glucose. In some embodiments, the analyte binding domain of the analyte binding compound comprises, consists essentially of, or consists of a glucose binding protein, a glucose binding portion or fragment of a glucose binding protein and/or a mimetic of a glucose binding protein (e.g., a peptidomimetic designed to mimic a glucose binding protein or peptide), or portion or fragment thereof. In some embodiments, the indicator compound further comprises a detectable domain (e.g., a luminescent domain), which comprises a luminescent protein and/or one or more luminescing fragments or portions of a luminescent protein, and/or one or more mimetics of luminescing proteins. In some embodiments, the indicator compound comprises a fluorescent domain, which comprises a fluorescent protein and/or one or more fluorescent fragments or portions of a fluorescent protein. In some embodiments, the indicator compounds emit a detectable radiation, such as light of a particular wavelength (e.g., luminescence and/or fluorescence), when an analyte molecule binds to the analyte binding region of the compound and/or when the complex (e.g., the indicator compound and the analyte molecule) are exposed to light. In some embodiments, the indicator compound, or luminescent protein and/or one or more luminescing fragments or portions of the luminescent protein thereof, undergoes a three-dimensional conformational change from a first conformation to a second conformation upon the binding of the analyte. In some embodiments, the conformational change induces a change in the indicator compound's absorption and/or emission of light. In some embodiments, the change in the indicator compound's absorption and/or emission of light is detectable. In some embodiments, for example, the luminescence of the indicator compound is different when in the second conformation than when in the first conformation. For example, in some embodiments, a glucose molecule is detected by a fluorescent signal at a specific wavelength when glucose enters and/or binds to a binding domain of the indicator compound.

In some embodiments, as disclosed elsewhere herein, the indicator compound is a fusion protein. In some embodiments, the fusion protein comprises a glucose binding protein or fragment thereof that is operably linked to a luminescent protein or luminescing fragment or portion thereof (e.g., a fluorescent protein or a fluorescing fragment or portion thereof). Also envisioned are nucleic acids that encode these proteins, vectors/plasmids/other expression systems that contain these nucleic acids, and cells that contain them. In some embodiments, these fusion proteins are genetically encoded and/or expressed or expressable within a host organism or cell.

Some embodiments pertain to a method for detecting sugar (e.g., glucose) in a patient. Some embodiments pertain to a method for detecting glucose in a diabetic patient. In some embodiments, the method comprises administering an indicator compound, as disclosed herein, to the patient. In some embodiments, the indicator compound is a fusion protein, as disclosed elsewhere herein. In some embodiments, the fusion protein comprises a luminescent protein and/or a one or more luminescing fragments of a luminescent protein. In some embodiments, the fusion protein comprises a sugar binding protein and/or a sugar binding portion of a sugar binding protein. In some embodiments, the sugar binding protein and/or sugar binding portion of the sugar binding protein is configured to bind glucose. In some embodiments, when glucose is bound by the sugar binding protein and/or sugar binding portion of the sugar binding protein, the indicator compound undergoes a conformational change from a first conformation to a second conformation. In some embodiments, the luminescence, fluorescence, absorption, and/or emission of the indicator compound is different when in the second conformation than when in the first conformation.

In some embodiments, the method comprises quantifying a glucose level in the patient based on a change in luminescence and/or fluorescence of the indicator compound.

In some embodiments, the indicator compound is a split luminescent protein. In some embodiments, the luminescent protein is a fluorescent protein. In some embodiments, the luminescent protein and/or a one or more luminescing fragments of a luminescent protein is at least 60%, 65%, 70%, 75%, 80%, 85%, 90%, 95%, 96%, 97%, 98%, 99%, 99.5%, or 100% identical to one or more of SEQ ID NO:1, SEQ ID NO:14, or SEQ ID NO: 34-121 and/or shares at least 60%, 65%, 70%, 75%, 80%, 85%, 90%, 95%, 96%, 97%, 98%, 99%, 99.5%, or 100% homology or similarity to one or more of SEQ ID NO:1, SEQ ID NO:14, or SEQ ID NO: 34-121. In some embodiments, the luminescent protein and/or a one or more luminescing fragments of a luminescent protein is at least 80% to 100% identical to one or more of SEQ ID NO:1, SEQ ID NO:14, or SEQ ID NO: 34-121 and/or shares at least 80% to 100% homology or similarity to one or more of SEQ ID NO:1, SEQ ID NO:14 or SEQ ID NO: 34-121. In some embodiments, the luminescent protein and/or one or more luminescing fragments of a luminescent protein (and/or a contiguous portion of the luminescent protein and/or one or more luminescing fragments of a luminescent protein) is at least 60%, 65%, 70%, 75%, 80%, 85%, 90%, 95%, 96%, 97%, 98%, 99%, 99.5%, or 100% identical to a contiguous portion of one or more of SEQ ID NO:1, SEQ ID NO:14, or SEQ ID NO: 34-121 and/or shares at least 60%, 65%, 70%, 75%, 80%, 85%, 90%, 95%, 96%, 97%, 98%, 99%, 99.5%, or 100% homology or similarity to a contiguous portion of one or more of SEQ ID NO:1, SEQ ID NO:14, or SEQ ID NO: 34-121. In some embodiments, the luminescent protein and/or one or more luminescing fragments of a luminescent protein is at least 80% to 100% identical to a contiguous portion of one or more of SEQ ID NO:1, SEQ ID NO:14 or SEQ ID NO: 34-121 and/or shares at least 80% to 100% homology or similarity to a contiguous portion of one or more of SEQ ID NO:1, SEQ ID NO:14, or SEQ ID NO: 34-121. In some embodiments, the contiguous portion of one or more of SEQ ID NO:1, SEQ ID NO:14, or SEQ ID NO: 34-121 is equal to or at least about: 200, 150, 100, 80, 60, 50, 40, 30, 20, or 10 amino acids in length (or ranges including and/or spanning the aforementioned values). In some embodiments, the contiguous portion of one or more of SEQ ID NO: 1, SEQ ID NO: 14, or SEQ ID NO: 34-121 optionally has 1, 2, 3, 4, 5, 6, 7, 8, 9, or 10 amino acid differences. In some embodiments, the amino acid differences include insertions, deletions, and/or substitutions. In some embodiments, the substitutions can include a substitution of any one or more of amino acids A, C, D, E, F, G, H, I, K, L, M, N, P, Q, R, S, T, V, W, or Y to any one or more of amino acids A, C, D, E, F, G, H, I, K, L, M, N, P, Q, R, S, T, V, W, or Y. In some embodiments, where the luminescent protein and/or one or more luminescing fragments of a luminescent protein is split (as disclosed elsewhere herein), two or more contiguous portions of the luminescing protein and/or fragment thereof may align with one or more contiguous portions of SEQ ID NO:1, SEQ ID NO:14, or SEQ ID NO: 34-121.

In some embodiments are the nucleic acid sequences that translate to one or more luminescent proteins having the sequence of SEQ ID NO: 1, SEQ ID NO: 14, or SEQ ID NO: 34-121. It is envisioned that multiple nucleic acids sequences can be translated to the luminescent proteins disclosed herein. In some embodiments, the nucleic acid sequences differ by codons that encode for the same amino acid. In some embodiments, the nucleic acid sequences are codon optimized for a certain organism, such as a human, mouse, rat, rabbit, dog, cat, horse, goat, pig, chicken, fungus, yeast, bacteria, or protozoan.

In some embodiments, the luminescent protein or luminescing fragment of a luminescent protein is, obtained, or derived from a luminescent organism. In some embodiments, the luminescent protein or luminescing fragment of a luminescent protein is, obtained, or derived from a fluorescent organism. In some embodiments, the luminescent protein or luminescent fragment of a luminescent protein is, obtained, or derived from *Aequorea, Aequorea victoria, Aequorea macrodactyla, Aequorea coerulescens, Entacmaea, Entacmaea quadricolor, Anemonia, Anemonia manajo, Anemonia sulcate, Acropora, Clavularia, Galaxea, Galaxea fascicularis, Zoanthus, Pontellina, Pontellina plumata, Phialidium, Verrillofungia, Verrillofungia concinna, Discosoma, Anthoatecata, Heteractis, Heteractis crispa, Actinia, Actinia equina, Trachyphyllia, Trachyphyllia geoffroyi, Favia, Favia favus, Lobophyllia, Lobophyllia hemprichii,* or *Echinophyllia.* In some embodiments, the luminescent protein or luminescent fragment of a luminescent protein is, obtained, or derived from a mammalian protein. In some embodiments, the luminescent protein or luminescent fragment of a luminescent protein is, obtained, or derived from a human protein.

In some embodiments, the sugar binding protein and/or sugar binding portion of the sugar binding protein is, obtained, or derived from a bacterial protein. In some embodiments, the sugar binding protein and/or sugar binding portion of the sugar binding protein is, obtained, or derived from a Proteobacteria protein. In some embodiments, the sugar binding protein and/or sugar binding portion of the sugar binding protein is, obtained, or derived from an *E. coli* protein. In some embodiments, the sugar binding protein and/or sugar binding portion of the sugar binding protein is a periplasmic protein or sugar binding portion thereof. In some embodiments, the sugar binding protein and/or sugar binding portion of the sugar binding protein is, obtained, or derived from a mammalian protein. In some embodiments, the sugar binding protein and/or sugar binding portion of the sugar binding protein is, obtained, or derived from a human protein.

In some embodiments, the sugar binding protein and/or sugar binding portion of the sugar binding protein is at least 60%, 65%, 70%, 75%, 80%, 85%, 90%, 95%, 96%, 97%, 98%, 99%, 99.5%, or 100% identical to one or more of SEQ ID NO:2 or SEQ ID NO:15 and/or shares at least 60%, 65%, 70%, 75%, 80%, 85%, 90%, 95%, 96%, 97%, 98%, 99%, 99.5%, or 100% homology or similarity to one or more of SEQ ID NO:2 or SEQ ID NO:15. In some embodiments, the sugar binding protein and/or sugar binding portion of the sugar binding protein is at least 80% to 100% identical to one or more of SEQ ID NO:2 or SEQ ID NO:15 and/or shares at least 80% to 100% homology or similarity to one or more of SEQ ID NO:2 or SEQ ID NO:15. In some embodiments, the sugar binding protein and/or sugar binding portion of the sugar binding protein (and/or a contiguous portion of the sugar binding protein and/or sugar binding portion of the sugar binding protein) is at least 60%, 65%, 70%, 75%, 80%, 85%, 90%, 95%, 96%, 97%, 98%, 99%, 99.5%, or 100% identical to a contiguous portion of one or more of SEQ ID NO:2 or SEQ ID NO:15 and/or shares at least 60%, 65%, 70%, 75%, 80%, 85%, 90%, 95%, 96%, 97%, 98%, 99%, 99.5%, or 100% homology or similarity to a contiguous portion of one or more of SEQ ID NO:2 or SEQ ID NO:15. In some embodiments, the sugar binding protein and/or sugar binding portion of the sugar binding protein is at least 80% to 100% identical to a contiguous portion of one or more of SEQ ID NO:2 or SEQ ID NO:15 and/or shares at least 80% to 100% homology or similarity to a contiguous portion of one or more of SEQ ID NO:2 or SEQ ID NO:15. In some embodiments, the contiguous portion of one or more of SEQ ID NO:2 or SEQ ID NO:15 is equal to or at least about: 300, 250, 200, 150, 100, 80, 60, 50, 40, 30, 20, or 10 amino acids in length (or ranges including and/or spanning the aforementioned values). In some embodiments, the contiguous portion of one or more of SEQ ID NO: 2 or SEQ ID NO: 15 optionally has 1, 2, 3, 4, 5, 6, 7, 8, 9, or 10 amino acid differences. In some embodiments, the amino acid differences include insertions, deletions, and/or substitutions. In some embodiments, the substitutions can include a substitution of any one or more of amino acids A, C, D, E, F, G, H, I, K, L, M, N, P, Q, R, S, T, V, W, or Y to any one or more of amino acids A, C, D, E, F, G, H, I, K, L, M, N, P, Q, R, S, T, V, W, or Y. In some embodiments, where the sugar binding protein and/or sugar binding portion of the sugar binding protein is split, two or more contiguous portions of the sugar binding protein and/or sugar binding portion of the sugar binding protein may align with one or more contiguous portions of SEQ ID NO:2 or SEQ ID NO:15.

In some embodiments, the indicator compound is at least 60%, 65%, 70%, 75%, 80%, 85%, 90%, 95%, 96%, 97%, 98%, 99%, 99.5%, or 100% identical to one or more of SEQ ID NOS: 3-13 and 16-20 and/or shares at least 60%, 65%, 70%, 75%, 80%, 85%, 90%, 95%, 96%, 97%, 98%, 99%, 99.5%, or 100% homology or similarity to one or more of SEQ ID NOS: 3-13 and 16-20. In some embodiments, the indicator compound is at least 80% to 100% identical to one or more of SEQ ID NOS: 3-13 and 16-20 and/or shares at least 80% to 100% homology or similarity to one or more of SEQ ID NOS: 3-13 and 16-20. In some embodiments, a contiguous portion of the indicator compound is at least 60%, 65%, 70%, 75%, 80%, 85%, 90%, 95%, 96%, 97%, 98%, 99%, or 100% identical to a contiguous portion of one or more of SEQ ID NOS: 3-13 and 16-20 and/or shares at least 60%, 65%, 70%, 75%, 80%, 85%, 90%, 95%, 96%, 97%, 98%, 99%, or 100% homology or similarity to a contiguous portion of one or more of SEQ ID NOS: 3-13 and 16-20. In some embodiments, a contiguous portion of the indicator compound is at least 80% to 100% identical to a contiguous portion of one or more of SEQ ID NOS: 3-13 and 16-20 and/or shares at least 80% to 100% homology or similarity to a contiguous portion of one or more of SEQ ID NOS: 3-13 and 16-20. In some embodiments, the contiguous portion of the indicator compound is a portion of the compound that is equal to or at least about: 500, 450, 400, 350, 300, 250, 200, 150, 100, 80, 60, 50, or 40 amino acids in length (or ranges including and/or spanning the aforementioned values). In some embodiments, the contiguous portion of SEQ ID NOS: 3-13 and 16-20 is a portion of those proteins that is equal to or at least about: 500, 450, 400, 350, 300, 250, 200, 150, 100, 80, 60, 50, or 40 amino acids in length (or ranges including and/or spanning the aforementioned values). In some embodiments, the contiguous portion of one or more of SEQ ID NOs: 3-13 or SEQ ID NOs: 16-20 optionally has 1, 2, 3, 4, 5, 6, 7, 8, 9, or 10 amino acid differences. In some embodiments, the amino acid differences include insertions, deletions, and/or substitutions. In some embodiments, the substitutions can include a substitution of any one or more of amino acids A, C, D, E, F, G, H, I, K, L, M, N, P, Q, R, S, T, V, W, or Y to any one or more of amino acids A, C, D, E, F, G, H, I, K, L, M, N, P, Q, R, S, T, V, W, or Y. In some embodiments, two or more contiguous portions of the indicator compound may align with one or more contiguous portions of SEQ ID NOS: 3-13 and 16-20.

In some embodiments, the indicator compound is encoded by DNA having a region that is at least 60%, 65%, 70%, 75%, 80%, 85%, 90%, 95%, 96%, 97%, 98%, 99%, or 100% identical to one or more of SEQ ID NOS: 21-33 and/or at least 60%, 65%, 70%, 75%, 80%, 85%, 90%, 95%, 96%, 97%, 98%, 99%, 99.5%, or 100% homology or similarity to one or more of SEQ ID NOS: 21-33. In some embodiments, the indicator compound is encoded by DNA having a region that is at least 80% to 100% identical to one or more of SEQ ID NOS: 21-33 and/or at least 80% to 100% homology or similarity to one or more of SEQ ID NOS: 21-33. In some embodiments, a contiguous portion of the DNA encoding the indicator compound is at least 60%, 65%, 70%, 75%, 80%, 85%, 90%, 95%, 96%, 97%, 98%, 99%, 99.5%, or 100% identical to a contiguous portion of one or more of SEQ ID NOS: 21-33 and/or shares at least 60%, 65%, 70%, 75%, 80%, 85%, 90%, 95%, 96%, 97%, 98%, 99%, or 100% homology or similarity to a contiguous portion of one or more of SEQ ID NOS: 21-33. In some embodiments, a contiguous portion of the DNA encoding the indicator compound is at least 80% to 100% identical to a contiguous portion of one or more of SEQ ID NOS: 21-33 and/or shares at least 80% to 100% homology or similarity to a contiguous portion of one or more of SEQ ID NOS: 21-33. In some embodiments, the contiguous portion of the DNA encoding the indicator compound is equal to or at least about: 1500, 1000, 900, 800, 700, 600, 500, 400, 300, 200, 150, 100, 80, 60, 50, or 40 nucleotides in length (or ranges including and/or spanning the aforementioned values). In some embodiments, the contiguous portion of one or more of SEQ ID NOS: 21-33 is a portion of the those DNAs that is equal to or at least about: 1500, 1000, 900, 800, 700, 600, 500, 400, 300, 200, 150, 100, 80, 60, 50, or 40 nucleotides in length (or ranges including and/or spanning the aforementioned values).

In some embodiments, the indicator compound is administered to the patient using a cell. In some embodiments, the cell is allogeneic to the patient. In some embodiments, the cell is autologous to the patient. In some embodiments, the cell comprises DNA having a region that is equal to or at least about: 60%, 65%, 70%, 75%, 80%, 85%, 90%, 95%, 96%, 97%, 98%, 99%, or 100% identical to one or more of SEQ ID NOS: 21-33 (or ranges including and/or spanning the aforementioned values). In some embodiments, the cell comprises DNA having a region that is at least 80% to 100% identical to one or more of SEQ ID NOS: 21-33. In some embodiments, the cell is part of a skin graft received by the patient. In some embodiments, the cell is part of a synthetic skin graft received by the patient. In some embodiments, the cell is a keratinocyte, melanocyte, Langerhans cell, Merkel cell, immune cell, macrophage, epithelial cell, or red blood cell.

In some embodiments, the analyte is NADPH, $H^+$ (pH), heavy metal, calcium, sodium, potassium, chloride, iron, copper, zinc, magnesium, phosphorus, urea, creatinine, phosphate, $O_2$, $CO_2$, bicarbonate, cholesterol, high-density lipoproteins (HDL), low-density lipoproteins (LDL), triglyceride, C-reactive protein, thyroid stimulating hormone (TSH), parathyroid hormone (PTH), thyroxine, triiodothyronine, albumin, globulin, immunoglobulin, bilirubin, alpha fetoprotein (AFP), human chorionic gonadotropin (HCG), carcinoembryonic antigen, prostate specific antigen (PSA), prostatic acid phosphatase (PAP), calcitonin, testosterone, dihydrotestosterone, progesterone, follicle stimulating hormone (FSH), luteinizing hormone (LH), estradiol, cortisol, growth hormone, aldosterone, vitamin A, vitamin B, vitamin C, vitamin D, vitamin E, lead, ethanol, lactose dehydrogenase (LDH), or amylase, or any combination thereof, and the analyte binding protein and/or the analyte binding portion of an analyte binding protein is specific for this analyte.

In some embodiments, the indicator compound comprises a plurality of analyte binding proteins (and/or mimetics thereof) and/or analyte binding portion of an analyte binding protein, where each analyte binding protein and/or analyte binding portion of an analyte binding protein is specific for a unique analyte. In some embodiments, the indicator compound comprises a plurality of analyte binding proteins (and/or mimetics thereof) and/or analyte binding portion of an analyte binding protein, where each analyte binding protein and/or analyte binding portion of an analyte binding protein is specific for a common analyte. In some embodiments, the indicator compound also comprises a plurality of luminescent proteins and/or luminescing fragments of a luminescing protein, wherein each luminescent protein and/or luminescing fragment of a luminescing protein is operably linked to a first analyte binding protein or analyte binding portion of an analyte binding protein such that each luminescent protein and/or luminescing fragment of a luminescing protein is configured to undergo a conformational change only when an analyte is bound to the first analyte binding protein or analyte binding portion of an analyte binding protein and not when a second analyte is bound to a second analyte binding protein or analyte binding portion of an analyte binding protein. In other embodiments, each luminescent protein and/or luminescing fragment of a luminescent protein in the plurality is configured to undergo a conformational change when at least one of a plurality of analytes are bound to the respective analyte binding protein and/or analyte binding portion of the analyte binding protein.

In some embodiments, the indicator compound comprises a luminescent dye and an analyte binding protein and/or analyte binding portion of an analyte binding protein, wherein the indicator compound is configured to undergo a conformational change from a first conformation to a second conformation when the analyte is bound by the analyte binding protein and/or analyte binding portion of the analyte binding protein and the luminescence of the indicator compound is different when in the second conformation than when in the first conformation as a result of the luminescence of the luminescent dye. In some embodiments, the luminescent dye is a solvatochromic dye. In some embodiments, the luminescent dye is used in a Förster resonance energy transfer (FRET) configuration.

In some embodiments, the patient is an animal. In some embodiments, the patient is a mammal. In some embodiments, the patient is human.

In some embodiments, the method comprises illuminating the indicator compound with light having a first wavelength maximum and detecting an emission of light at the second wavelength maximum.

Some embodiments pertain to the indicator compound as disclosed elsewhere herein. For example, in some embodiments, the indicator compound comprises a luminescent protein and/or a one or more luminescing fragments of a luminescent protein. In some embodiments, the indicator compound comprises a sugar binding protein and/or a sugar binding portion of a sugar binding protein. In some embodiments, the indicator compound is configured to bind glucose at the sugar binding protein and/or sugar binding portion of the sugar binding protein. In some embodiments, the indicator compound is configured to undergo a conformational change from a first conformation to a second conformation when glucose is bound at the sugar binding protein and/or sugar binding portion of the sugar binding protein. In some embodiments, the light absorption or emission of the indicator compound is different when in the second conformation than when in the first conformation. In some embodiments, the indicator compound is configured for in vivo use.

Some embodiments pertain to a composition suitable for administration to a human comprising the indicator compound as disclosed elsewhere herein.

Some embodiments pertain to a method of manufacturing the indicator compound as disclosed elsewhere herein comprising expressing the indicator compound encoded by a vector in a recombinant host cell and isolating the compound from the recombinant host cell. In some embodiments, the vector comprises one or more of: a nucleic acid sequence encoding a luminescent protein and/or a one or more luminescing fragments of a luminescent protein; and a nucleic acid sequence encoding a sugar binding protein and/or a sugar binding portion of a sugar binding protein. In some embodiments, the vector further comprises a signal sequence. In some embodiments, the recombinant host cell is selected from an insect cell, a fungal cell, a bacterial cell, an animal cell line, and a transgenic animal cell. In some embodiments, the recombinant host cell is an E. coli cell, a CHO cell, or a HEK293 cell, etc.

In some embodiments, an implantable glucose sensor for determining the presence or concentration of glucose in an animal is provided. In some embodiments, the sensor can comprise a sensor body having an outer surface surrounding the sensor body. In some embodiments, the sensor can comprise a radiation source in said sensor body which emits radiation within said sensor body. In some embodiments, the sensor comprises an indicator compound as disclosed herein. In some embodiments, the indicator compound is affected by the presence or concentration of glucose in the animal. In some embodiments, the sensor can comprise a photosensitive element located in the sensor body, positioned to receive radiation within the sensor body, where the photosensitive element is configured to emit a signal responsive to radiation received from the indicator compound and which is indicative of the presence or concentration of glucose in an animal. In some embodiments, the sensor can comprise a protective barrier comprising silver, palladium, platinum, manganese, or alloys, or gold-inclusive alloys, or combinations thereof, at least partially surrounding said indicator element.

Some embodiments pertain to a method for detecting glucose in a patient (e.g., a diabetic patient) comprising administering an indicator compound to the patient. In some embodiments, the indicator compound is a fusion protein comprising: a luminescent protein and/or one or more luminescing fragments of a luminescent protein; and a sugar binding protein and/or a sugar binding portion of a sugar binding protein; wherein the sugar binding protein and/or the sugar binding portion of the sugar binding protein is configured to bind glucose; wherein, when glucose is bound by the sugar binding protein and/or the sugar binding portion of the sugar binding protein, the indicator compound undergoes a conformational change from a first conformation to a second conformation; wherein the luminescence of the indicator compound is different when in the second conformation than when in the first conformation.

In some embodiments, the method further comprises quantifying a glucose level in the patient based on a change in luminescence of the indicator compound when in the second conformation.

In some embodiments, the luminescent protein is a split luminescent protein. In some embodiments, the luminescent protein is a fluorescent protein. In some embodiments, the luminescent protein and/or one or more luminescing fragments of the luminescent protein is at least 80% to 100% identical to one or more of SEQ ID NO:1, SEQ ID NO:14 or SEQ ID NO: 34-121 and/or shares at least 80% to 100% homology or similarity to one or more of SEQ ID NO:1, SEQ ID NO:14, or SEQ ID NO: 34-121. In some embodiments, the sugar binding protein and/or sugar binding portion of the sugar binding protein is a periplasmic protein or sugar binding portion thereof. In some embodiments, the sugar binding protein and/or sugar binding portion of the sugar binding protein is at least 80% to 100% identical to one or more of SEQ ID NO:2 or SEQ ID NO:15 and/or shares at least 80% to 100% homology or similarity to one or more of SEQ ID NO:2 or SEQ ID NO:15.

In some embodiments, the indicator compound is at least 80% to 100% identical to one or more of SEQ ID NOS: 3-13 and 16-20 and/or shares at least 80% to 100% homology or similarity to one or more of SEQ ID NOS: 3-13 and 16-20. In some embodiments, the indicator compound is encoded by DNA having a region that is at least 80% to 100% identical to one or more of SEQ ID NOS: 21-33 and/or at least 80% to 100% homology or similarity to one or more of SEQ ID NOS: 21-33.

In some embodiments, the indicator compound is administered to the patient using a cell. In some embodiments, the cell is autologous to the patient. In some embodiments, the cell comprises DNA having a region that is at least 80% to 100% identical to one or more of SEQ ID NOS: 21-33. In some embodiments, the cell is part of a skin graft received by the patient. In some embodiments, the cell is a keratinocyte, melanocyte, Langerhans cell, Merkel cell, immune cell, macrophage, epithelial cell, or red blood cell. In some embodiments, the patient is human.

In some embodiments, the indicator compound is illuminated with light having a first maximum wavelength and detecting an emission of light at a second maximum wavelength.

Some embodiments pertain to an indicator compound comprising: a luminescent protein and/or a one or more luminescing fragments of a luminescent protein; and a sugar binding protein and/or a sugar binding portion of a sugar binding protein; wherein the indicator compound is configured to bind glucose at the sugar binding protein and/or sugar binding portion of the sugar binding protein; wherein the indicator compound is configured to undergo a conformational change from a first conformation to a second conformation when glucose is bound by the sugar binding protein and/or sugar binding portion of the sugar binding protein; wherein the luminescence of the indicator compound is different when in the second conformation than when in the first conformation.

In some embodiments, the indicator compound is configured for in vivo use. In some embodiments, the luminescent protein is a split luminescent protein. In some embodiments, the luminescent protein is a fluorescent protein.

In some embodiments, the luminescent protein and/or a one or more luminescing fragments of a luminescent protein is at least 80% to 100% identical to one or more of SEQ ID NO:1, SEQ ID NO:14, or SEQ ID NO: 34-121 and/or shares at least 80% to 100% homology or similarity to one or more of SEQ ID NO:2 or SEQ ID NO:15.

In some embodiments, the sugar binding protein and/or sugar binding portion of the sugar binding protein is a periplasmic protein or sugar binding portion thereof.

In some embodiments, the sugar binding protein and/or sugar binding portion of the sugar binding protein is at least 80% to 100% identical to one or more of SEQ ID NO:2 or SEQ ID NO:15 and/or shares at least 80% to 100% homology or similarity to one or more of SEQ ID NO:2 or SEQ ID NO:15.

In some embodiments, the indicator compound is at least 80% to 100% identical to one or more of SEQ ID NOS: 3-13 and 16-20 and/or shares at least 80% to 100% homology or similarity to one or more of SEQ ID NOS: 3-13 and 16-20.

In some embodiments, the indicator compound is encoded by DNA having a region that is at least 80% to 100% identical to one or more of SEQ ID NOS: 21-33 and/or at least 80% to 100% homology or similarity to one or more of SEQ ID NOS: 21-33.

Some embodiments pertain to a composition suitable for administration to a human comprising the compound disclosed herein.

Some embodiments pertain to a method of manufacturing the indicator compound comprising expressing the indicator compound encoded by a vector in a recombinant host cell, and isolating the compound from the recombinant host cell.

In some embodiments, the vector comprises: a nucleic acid sequence encoding the luminescent protein and/or one or more luminescing fragments of a luminescent protein; and a nucleic acid sequence encoding the sugar binding protein and/or sugar binding portion of a sugar binding protein. In some embodiments, the vector further comprises a signal sequence.

In some embodiments, the recombinant host cell is selected from an insect cell, a fungal cell, a bacterial cell, an animal cell, and a transgenic animal cell. In some embodiments, the recombinant host cell is an E. coli cell, a CHO cell, a HEK293 cell, etc.

Some embodiments pertain to a method for detecting an analyte in a patient comprising: administering an indicator compound to the patient, wherein the indicator compound is a fusion protein comprising: a luminescent protein and/or one or more luminescing fragments of a luminescent protein; and an analyte binding protein and/or an analyte binding portion of an analyte binding protein; wherein, when the analyte is bound by the analyte binding protein and/or the analyte binding portion of the analyte binding protein, the indicator compound undergoes a conformational change from a first conformation to a second conformation; wherein the luminescence of the indicator compound is different when in the second conformation than when in the first conformation.

In some embodiments, an analyte level is quantified in the patient based on a change in luminescence of the indicator compound when in the second conformation.

In some embodiments, the luminescent protein is a split luminescent protein. In some embodiments, the luminescent protein is a fluorescent protein. In some embodiments, the indicator compound is administered to the patient using a cell. In some embodiments, the cell is autologous to the patient. In some embodiments, the cell is part of a skin graft received by the patient. In some embodiments, the cell is a keratinocyte, melanocyte, Langerhans cell, Merkel cell, immune cell, macrophage, epithelial cell, or red blood cell.

In some embodiments, the patient is human.

In some embodiments, the method further comprises illuminating the indicator compound with light having a first maximum wavelength and detecting an emission of light at a second maximum wavelength.

Some embodiments pertain to an indicator compound. In some embodiments, the indicator compound comprises a luminescent protein and/or a one or more luminescing fragments of a luminescent protein. In some embodiments, the indicator compound comprises an analyte binding protein and/or an analyte binding portion of an analyte binding protein. In some embodiments, the indicator compound is configured to undergo a conformational change from a first conformation to a second conformation when the analyte is bound by the analyte binding protein and/or analyte binding portion of the analyte binding protein. In some embodiments, the luminescence of the indicator compound is different when in the second conformation than when in the first conformation. In some embodiments, the indicator compound is configured for in vivo use. In some embodiments, the luminescent protein is a split luminescent protein. In some embodiments, the luminescent protein is a fluorescent protein.

Some embodiments pertain to a composition suitable for administration to a human comprising an indicator compound as disclosed anywhere herein.

Some embodiments pertain to a method of manufacturing the compound as disclosed anywhere herein comprising expressing the indicator compound encoded by a vector in a recombinant host cell, and isolating the compound from the recombinant host cell.

In some embodiments, the vector comprises: a nucleic acid sequence encoding the luminescent protein and/or one or more luminescing fragments of a luminescent protein; and a nucleic acid sequence encoding the analyte binding protein and/or analyte binding portion of an analyte binding protein. In some embodiments, the vector further comprises a signal sequence. In some embodiments, the recombinant host cell is selected from an insect cell, a fungal cell, a bacterial cell, an animal cell, and a transgenic animal cell.

In some embodiments, for any of the devices, indicator compounds, compositions, or methods herein, the analyte is a sugar, glucose, NADPH, H$^+$ (pH), heavy metal, calcium, sodium, potassium, chloride, iron, copper, zinc, magnesium, phosphorus, urea, creatinine, phosphate, O$_2$, CO$_2$, bicarbonate, cholesterol, HDL, LDL, triglyceride, C-reactive protein, TSH, PTH, thyroxine, triiodothyronine, albumin, globulin, immunoglobulin, bilirubin, AFP, HCG, carcinoembryonic antigen, PSA, PAP, calcitonin, testosterone, dihydrotestosterone, progesterone, FSH, LH, estradiol, cortisol, growth hormone, aldosterone, vitamin A, vitamin B, vitamin C, vitamin D, vitamin E, lead, ethanol, LDH, or amylase, or any combination thereof.

BRIEF DESCRIPTION OF THE DRAWINGS

FIG. 1A-1C are depictions of embodiments of indicator compounds and their activation by analyte binding.

FIG. 2A depicts an amino acid sequence (e.g., SEQ ID NO: 1) for an embodiment of a fluorescent protein.

FIG. 2B depicts an amino acid sequence (e.g., SEQ ID NO: 2) for an embodiment of an analyte binding protein (e.g., glucose).

FIGS. 2C(1)-2C(11) depict amino acid sequences (e.g., SEQ ID NOs: 3-13) for some embodiments of fusion proteins that may be used as indicator compounds.

FIG. 3A depicts an amino acid sequence (e.g., SEQ ID NO: 14) for an embodiment of a fluorescent protein.

FIG. 3B depicts an amino acid sequence (e.g., SEQ ID NO: 15) for an embodiment of an analyte binding protein (e.g., glucose).

FIGS. 3C(1)-3C(5) depict amino acid sequences (e.g., SEQ ID NO: 16-20) for some embodiments of fusion proteins that may be used as indicator compounds.

FIGS. 4A(1)-4A(8) depict DNA strands encoding some embodiments of indicator compounds as disclosed herein (e.g., SEQ ID NOs: 21-28).

FIGS. 5A(1)-5A(5) depict DNA strands encoding some embodiments of indicator compounds as disclosed herein (e.g., SEQ ID NOs: 29-33).

FIGS. 6A(1)-6A(54) depict various fluorescent proteins that can be used in the indicator compounds disclosed herein.

FIGS. 7A(1)-7A(88) depict proteins and/or amino acid sequences (e.g., SEQ ID NOs: 34-122) for additional fluorescent proteins for use in some embodiments.

FIGS. 8A(1)-8A(100) depict proteins and/or amino acid sequences (e.g., SEQ ID NOs: 122-221) for concanavalin proteins for use in some embodiments.

FIGS. 9A(1)-9A(43) depict proteins and/or amino acid sequences (e.g., SEQ ID NOs: 1704-1746) for glucose/galactose-binding protein (GGBP) proteins for use in some embodiments.

DETAILED DESCRIPTION

Figure 1A:
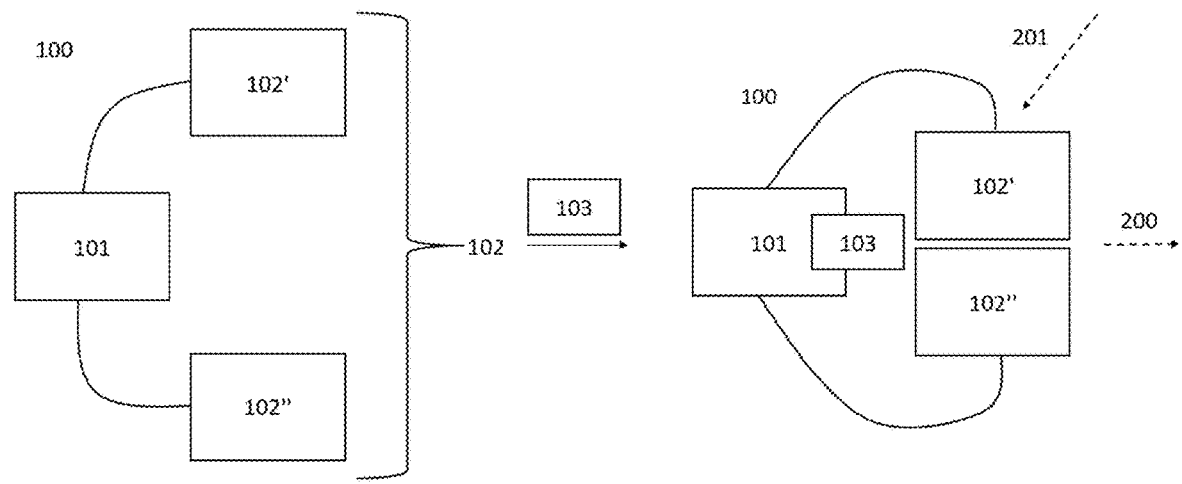

Some embodiments disclosed herein provide compounds (e.g., proteins, fusion proteins, and/or the polynucleotides that encode them), compositions comprising those compounds, the manufacture of those compounds and compositions, devices comprising those compounds, and their use in detecting an analyte. In some embodiments, the compounds disclosed herein are indicator compounds. In some embodiments, in response to the presence of an analyte (e.g., the binding of the analyte to a binding region within the indicator compound), the indicator compound causes a measurable signal (e.g., emits a measurable signal) allowing the quantification of the analyte. In some embodiments, the analyte is a sugar. In some embodiments, the analyte is glucose. In some embodiments, where the analyte is glucose, the indicator compound can be used to measure glucose levels in real time and/or in vivo to allow a subject to monitor and help regulate their glucose levels. In some embodiments, the subject is a diabetic patient. In some embodiments, the indicator compound is provided in a cell. In some embodiments, the cell is a cell of the patient. In some embodiments, the cell of the patient is a skin cell. In some embodiments, the signals emitted from the indicator compound are measured at the surface of the skin. The following description provides context and examples, but should not be interpreted to limit the scope of the inventions covered by the claims that follow in this specification or in any other application that claims priority to this specification. No single component or collection of components is essential or indispensable. Any feature, structure, component, material, step, or method that is described and/or illustrated in any embodiment in this specification can be used with or instead of any feature, structure, component, material, step, or method that is described and/or illustrated in any other embodiment in this specification.

Unless otherwise defined, all technical and scientific terms used herein have the same meaning as commonly understood by one of ordinary skill in the art to which this subject matter belongs. The terminology used in the description of the subject matter herein is for the purpose of describing particular embodiments only and is not intended to be limiting of the subject matter.

The articles "a" and "an" are used herein to refer to one or to more than one (for example, at least one) of the grammatical object of the article. By way of example, "an element" means one element or more than one element.

The terms "about" or "around" as used herein refer to a quantity, level, value, number, frequency, percentage, dimension, size, amount, weight or length that varies by as much as 30, 25, 20, 15, 10, 9, 8, 7, 6, 5, 4, 3, 2 or 1% to a reference quantity, level, value, number, frequency, percentage, dimension, size, amount, weight or length.

It is contemplated that various combinations or subcombinations of the specific features and aspects of the embodiments disclosed herein may be made and still fall within one or more of the inventions. Further, the disclosure herein of any particular feature, aspect, method, property, characteristic, quality, attribute, element, or the like in connection with an embodiment can be used in all other embodiments set forth herein. Accordingly, it should be understood that various features and aspects of the disclosed embodiments can be combined with or substituted for one another in order to form varying modes of the disclosed inventions. Thus, it is intended that the scope of the present inventions herein disclosed should not be limited by the particular disclosed embodiments described herein. Moreover, while the invention is susceptible to various modifications, and alternative forms, specific examples thereof have been shown in the drawings and are herein described in detail. It should be understood, however, that the invention is not to be limited to the particular forms or methods disclosed, but to the contrary, the invention is to cover all modifications, equivalents, and alternatives falling within the spirit and scope of the various embodiments described and in the appended claims. Any methods disclosed herein need not be performed in the order recited. The methods disclosed herein include certain actions taken by a practitioner; however, they can also include any third-party instruction of those actions, either expressly or by implication. For example, actions such as "implanting a glucose monitoring device" include "instructing the implantation of a glucose monitoring device." In addition, where features or aspects of the disclosure are described in terms of Markush groups, those skilled in the art will recognize that the disclosure is also thereby described in terms of any individual member or subgroup of members of the Markush group (e.g., "a, b, c, and/or d" also includes "a, b, and/or c").

The ranges disclosed herein also encompass any and all overlap, sub-ranges, and combinations thereof. Language such as "up to," "at least," "greater than," "less than," "between," and the like includes the number recited. Numbers preceded by a term such as "about" or "approximately" include the recited numbers. For example, "about 90%" includes "90%." In some embodiments, at least 95% identical in sequence includes 96%, 97%, 98%, 99%, and 100% identical in sequence to the reference sequence. In addition, when a sequence is disclosed as "comprising" a nucleotide or amino acid sequence, such a reference shall also include, unless otherwise indicated, that the sequence "comprises", "consists of" or "consists essentially of" the recited sequence.

Terms and phrases used in this application, and variations thereof, especially in the appended claims, unless otherwise expressly stated, should be construed as open ended as opposed to limiting. As examples of the foregoing, the term "including" should be read to mean "including, without limitation," "including but not limited to," or the like; the term "comprising" as used herein is synonymous with "including," "containing," or "characterized by," and is inclusive or open-ended and does not exclude additional, un-recited elements or method steps; the term "having" should be interpreted as "having at least;" the term "includes" should be interpreted as "includes but is not limited to;" the term "example" is used to provide exemplary instances of the item in discussion, not an exhaustive or limiting list thereof; and use of terms like "preferably," "preferred," "desired," or "desirable," and words of similar meaning should not be understood as implying that certain features are critical, essential, or even important to the structure or function of the invention, but instead as merely intended to highlight alternative or additional features that may or may not be utilized in a particular embodiment of the invention. In addition, the term "comprising" is to be interpreted synonymously with the phrases "having at least" or "including at least". When used in the context of a process, the term "comprising" means that the process includes at least the recited steps, but may include additional steps. When used in the context of a compound, composition or device, the term "comprising" means that the compound, composition or device includes at least the recited features or components, but may also include additional features or components. A group of items linked with the conjunction "or" should not be read as requiring mutual exclusivity among that group, but rather should be read as "and/or" unless expressly stated otherwise.

By "consisting of" is meant including, and limited to, whatever follows the phrase "consisting of." Thus, the phrase "consisting of" indicates that the listed elements are required or mandatory, and that no other elements may be present. By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they materially affect the activity or action of the listed elements.

The "individual", "patient" or "subject" treated as disclosed herein is, in some embodiments, a human patient, although it is to be understood that the principles of the presently disclosed subject matter indicate that the presently disclosed subject matter is effective with respect to all vertebrate species, including mammals, which are intended to be included in the terms "individual", "subject" and "patient." Suitable subjects are generally mammalian subjects. The subject matter described herein finds use in research as well as veterinary and medical applications. The term "mammal" as used herein includes, but is not limited to, humans, non-human animals, including primates, cattle, sheep, goats, pigs, horses, cats, dogs, rabbits, rodents (e.g., rats or mice), monkeys, etc. Human subjects and patients include neonates, infants, juveniles, adults and geriatric subjects. The subject can be a subject "in need of" the methods disclosed herein can be a subject that is experiencing a disease state and/or is anticipated to experience a disease state, and the methods and compositions of the invention are used for therapeutic and/or prophylactic treatment. A subject can be a patient, which refers to a human presenting to a medical provider for diagnosis or treatment of a disease. A subject can be afflicted with or is susceptible to a disease or disorder but may or may not display symptoms of the disease or disorder.

The term "effective amount," as used herein, refers to that amount of a recited compound that results in an observable effect, which, for example, can allow monitoring of an analyte related to a disease state of a patient. Actual dosage levels of active ingredients in an active composition of the presently disclosed subject matter can be varied so as to administer an amount of the active compound(s) that is effective to achieve the desired response for a particular subject and/or application. The selected dosage level will depend upon a variety of factors including, but not limited to, the activity of the composition, formulation, route of administration, combination with other drugs or treatments, severity of the condition being treated, and the physical condition and prior medical history of the subject being treated. In some embodiments, a minimal dose is administered, and dose is escalated in the absence of dose-limiting toxicity to a minimally effective amount. Determination and adjustment of an effective dose, as well as evaluation of when and how to make such adjustments, are contemplated herein.

The terms "function" and "functional" as used herein refer to a biological, enzymatic, or therapeutic function.

As used herein, "pharmaceutically acceptable" refers to carriers, excipients, and/or stabilizers that are nontoxic to the cell or mammal being exposed thereto at the dosages and concentrations employed or that have an acceptable level of toxicity. A "pharmaceutically acceptable" "diluent," "excipient," and/or "carrier" as used herein is intended to include any and all solvents, dispersion media, coatings, antibacterial and antifungal agents, isotonic and absorption delaying agents, and the like, compatible with administration to humans or other vertebrate hosts. Typically, a pharmaceutically acceptable diluent, excipient, and/or carrier is a diluent, excipient, and/or carrier approved by a regulatory agency of a Federal, a state government, or other regulatory agency, or listed in the U.S. Pharmacopeia or other generally recognized pharmacopeia for use in animals, including humans as well as non-human mammals. The term diluent, excipient, and/or "carrier" can refer to a diluent, adjuvant, excipient, or vehicle with which the pharmaceutical composition is administered. Such pharmaceutical diluent, excipient, and/or carriers can be sterile liquids, such as water and oils, including those of petroleum, animal, vegetable or synthetic origin. Water, saline solutions and aqueous dextrose and glycerol solutions can be employed as liquid diluents, excipients, and/or carriers, particularly for injectable solutions. Suitable pharmaceutical diluents and/or excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. A non-limiting example of a physiologically acceptable carrier is an aqueous pH buffered solution. The physiologically acceptable carrier may also comprise one or more of the following: antioxidants, such as ascorbic acid, low molecular weight (less than about 10 residues) polypeptides, proteins, such as serum albumin, gelatin, immunoglobulins, hydrophilic polymers such as polyvinylpyrrolidone, amino acids, carbohydrates such as glucose, mannose, or dextrins, chelating agents such as EDTA, sugar alcohols such as mannitol or sorbitol, salt-forming counterions such as sodium, and nonionic surfactants such as TWEEN®, polyethylene glycol (PEG), and PLURONICS®. The composition, if desired, can also contain minor amounts of wetting, bulking, emulsifying agents, or pH buffering agents. These compositions can take the form of solutions, suspensions, emulsion, sustained release formulations and the like. The formulation should suit the mode of administration.

Additional excipients with desirable properties include but are not limited to preservatives, adjuvants, stabilizers, solvents, buffers, diluents, solubilizing agents, detergents, surfactants, chelating agents, antioxidants, alcohols, ketones, aldehydes, ethylenediaminetetraacetic acid (EDTA), citric acid, salts, sodium chloride, sodium bicarbonate, sodium phosphate, sodium borate, sodium citrate, potassium chloride, potassium phosphate, magnesium sulfate sugars, dextrose, fructose, mannose, lactose, galactose, sucrose, sorbitol, cellulose, serum, amino acids, polysorbate 20, polysorbate 80, sodium deoxycholate, sodium taurodeoxycholate, magnesium stearate, octylphenol ethoxylate, benzethonium chloride, thimerosal, gelatin, esters, ethers, 2-phenoxyethanol, urea, or vitamins, or any combination thereof. Some excipients may be in residual amounts or contaminants from the process of manufacturing the immunogenic composition or vaccine, including but not limited to serum, albumin, ovalbumin, antibiotics, inactivating agents, formaldehyde, glutaraldehyde, β-propiolactone, gelatin, cell debris, nucleic acids, peptides, amino acids, or growth medium components or any combination thereof. The amount of the excipient may be found in an immunogenic composition or vaccine at a percentage of 0%, 0.1%, 0.2%, 0.3%, 0.4%, 0.5%, 0.6%, 0.7%, 0.8%, 0.9%, 1%, 2%, 3%, 4%, 5%, 6%, 7%, 8%, 9%, 10%, 20%, 30%, 40%, 50%, 60%, 70%, 80%, 90%, 95%, 100% w/w or any percentage by weight in a range defined by any two of the aforementioned numbers.

When values are described as being equal to or at least about: 70%, 80%, 90%, or 100% (or ranges including and/or spanning the aforementioned values), or where similar language is used, this recitation is meant to include values that may be equal to or at least about 70%, equal to or at least about 80%, equal to or at least about 90%, and/or equal to or at least about 100%. This recitation is also meant to include ranges, such as, those including and/or spanning about 70% to about 100%, about 80% to about 100%, about 70% to about 80%, about 80% to about 90%, etc. Additionally, the term "about" may be withdrawn. Thus, the recitation also includes the specific values of 80%, 90%, 100%, etc. This same terminology can be used with numbers that are equal to or less about a value.

As used herein, the term "isolated" refers to a substance and/or entity that has been (1) separated from at least some of the components with which it was associated when initially produced (whether in nature and/or in an experimental setting), and/or (2) produced, prepared, and/or manufactured by the hand of man. Isolated substances and/or entities may be separated from equal to or at least about: 10%, 20%, 30%, 40%, 50%, 60%, 70%, 80%, 90%, 95%, 98%, 99%, substantially 100%, or 100% of the other components with which they were initially associated (or ranges including and/or spanning the aforementioned values). In some embodiments, isolated agents are equal to or greater than about: 80%, 85%, 90%, 91%, 92%, 93%, 94%, 95%, 96%, 97%, 98%, 99%, substantially 100%, or 100% pure (or ranges including and/or spanning the aforementioned values). As used herein, a substance that is "isolated" may be "pure" (e.g., substantially free of other components). As used herein, the term "isolated cell" may refer to a cell not contained in a multi-cellular organism. In some embodiments, for example, a FP or glucose binding protein may be isolated from a natural source prior to combination.

The term "deoxynucleotide", as used herein, refers to a nucleotide or polynucleotide lacking an OH group at the 2' or 3' position of a sugar moiety with appropriate bonding and/or 2', 3' terminal dideoxy, instead having a hydrogen bonded to the 2' and/or 3' carbon.

The terms "deoxyribonucleotide" and "DNA", as used herein, refer to a nucleotide or polynucleotide comprising at least one ribosyl moiety that has an H at its 2' position of a ribosyl moiety instead of an OH. DNA may be in the form of, e.g., antisense molecules, plasmid DNA, pre-condensed DNA, a PCR product, vectors (PAC, BAC, YAC, artificial chromosomes), expression cassettes, chimeric sequences, chromosomal DNA, or derivatives and combinations of these groups.

"Polynucleotide," or "nucleic acid," as used interchangeably herein, refers to polymers of nucleotides of any length, and includes DNA and RNA. The nucleotides can be deoxyribonucleotides, ribonucleotides, unmodified nucleotides or bases, modified nucleotides or bases, and/or their analogs, or any substrate that can be incorporated into a polymer by DNA or RNA polymerase. A polynucleotide may comprise modified nucleotides, such as methylated nucleotides and their analogs. The term "nucleic acid" as used herein refers to a polymer containing at least two deoxyribonucleotides or ribonucleotides in either single- or double-stranded form and includes DNA and RNA. Nucleic acids include nucleic acids containing known nucleotide analogs or modified backbone residues or linkages, including for example locked nucleic acid (LNA), unlocked nucleic acid (UNA), and zip nucleic acid (ZNA), which can be synthetic, naturally occurring, and non-naturally occurring, and which have similar binding properties as the reference nucleic acid. Examples of such analogs include, without limitation, phosphorothioates, phosphoramidates, methyl phosphonates, chiral-methyl phosphonates, 2'-O-methyl ribonucleotides, and peptide-nucleic acids (PNAs). Unless specifically limited, the term encompasses nucleic acids containing known analogues of natural nucleotides that have similar binding properties as the reference nucleic acid. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues. "Nucleotides" contain a sugar deoxyribose (DNA) or ribose (RNA), a base, and a phosphate group. Nucleotides are linked together through the phosphate groups. "Bases" include purines and pyrimidines, which further include natural compounds adenine, thymine, guanine, cytosine, uracil, inosine, and natural analogs, and synthetic derivatives of purines and pyrimidines, which include, but are not limited to, modifications which place new reactive groups such as, but not limited to, amines, alcohols, thiols, carboxylases, and alkyl-halides. "Oligonucleotide," as used herein, generally refers to short, generally synthetic polynucleotides that are generally, but not necessarily, less than about 200 nucleotides in length. The terms "oligonucleotide" and "polynucleotide" are not mutually exclusive. The description above for polynucleotides is equally and fully applicable to oligonucleotides. In some embodiments, the polynucleotides disclosed herein (e.g., RNAi(s)) can include one or more nucleotides that is not naturally occurring to, for example, improve the stability of the polynucleotide. Some non-natural nucleotide modifications can include: phosphorothioate linkages, boranophosphate linkages, locked nucleic acids, 2'-modified RNA, 4'-thio modified RNA, ribo-difluorotoluyl nucleotides, uncharged nucleic acid mimics, siRNA conjugates including but not limited to peptide additions or polyethylene glycol. In some embodiments, the polynucleotide does not include non-natural nucleotides.

As used herein, the term "complementary" refers to the ability of polynucleotides to form base pairs with one another. Base pairs are typically formed by hydrogen bonds between nucleotide units in antiparallel polynucleotide strands or regions. Complementary polynucleotide strands or regions can base pair in the Watson-Crick manner (e.g., A to T, A to U, C to G), or in any other manner that allows for the formation of stable duplexes.

As used herein, "perfect complementarity" or "100% complementarity" refers to the situation in which each nucleotide unit of one polynucleotide strand or region can hydrogen bond with each nucleotide unit of a second polynucleotide strand or region. Less than perfect complementarity refers to the situation in which some, but not all, nucleotide units of two strands or two regions can hydrogen bond with each other. For example, for two 19-mers, if 17 base pairs on each strand or each region can hydrogen bond with each other, the polynucleotide strands exhibit 89.5% complementarity.

A "stringent hybridization" and "stringent hybridization wash conditions" in the context of nucleic acid hybridization are sequence dependent, and are different under different experimental parameters. Stringent hybridization conditions can include, e.g., hybridization in a buffer comprising 50% formamide, 5×SSC, and 1% SDS at 42° C., or hybridization in a buffer comprising 5×SSC and 1% SDS at 65° C. both with a wash of 0.2×SSC and 0.1% SDS at 65° C. Other stringent hybridization conditions can also include a hybridization in a buffer of 40% formamide, 1 M NaCl, and 1% SDS at 37° C., and a wash in 1×SSC at 45° C. Alternatively, hybridization to filter-bound DNA in 0.5 M NaHPC-4, 7% sodium dodecyl sulfate (SDS), 1 mM EDTA at 65° C., and washing in 0.1×SSC/0.1% SDS at 68° C. can be employed. Additional stringent hybridization conditions include hybridization at 60° C. or higher and 3×SSC (450 mM sodium chloride/45 mM sodium citrate) or incubation at 42° C. in a solution containing 30% formamide, 1 M NaCl, 0.5% sodium sarcosine, 50 mM MES, pH 6.5. Those of ordinary skill will readily recognize that alternative but comparable hybridization and wash conditions can be utilized to provide conditions of similar stringency. Wash conditions may include, e.g. a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by O.1×SSC containing 0.1% SDS at 68° C. for 15 minutes; or, equivalent conditions. Stringent conditions for washing can also be, e.g., 0.2×SSC/0.1% SDS at 42° C. In instances wherein the nucleic acid molecules are deoxyoligonucleotides ("oligos"), stringent conditions can include washing in 6×SSC/0.05% sodium pyrophosphate at 37° C. (for 14-base oligos), 48° C. (for 17-base oligos), 55° C. (for 20-base oligos), and 60° C. (for 23-base oligos).

As used herein, "expression vector" refers to a nucleic acid construct, generated recombinantly or synthetically, bearing a series of specified nucleic acid elements that enable transcription of a particular gene in a host cell. In some embodiments, gene expression is placed under the control of certain regulatory elements, such as constitutive or inducible promoters.

A nucleic acid or nucleic acid molecule can comprise one or more sequences encoding different peptides, polypeptides, or proteins. These one or more sequences can be joined in the same nucleic acid or nucleic acid molecule adjacently, or with extra nucleic acids in between, e.g. linkers, repeats or restriction enzyme sites, or any other sequence that is 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, or 300 bases long, or any length in a range defined by any two of the aforementioned lengths. The term "downstream" on a nucleic acid as used herein refers to a sequence being after the 3'-end of a previous sequence, on the strand containing the encoding sequence (sense strand) if the nucleic acid is double stranded. The term "upstream" on a nucleic acid as used herein refers to a sequence being before the 5'-end of a subsequent sequence, on the strand containing the encoding sequence (sense strand) if the nucleic acid is double stranded. The term "grouped" on a nucleic acid as used herein refers to two or more sequences that occur in proximity either directly or with extra nucleic acids in between, e.g. linkers, repeats, or restriction enzyme sites, or any other sequence that is 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, or 300 bases long, or any length in a range defined by any two of the aforementioned lengths, but generally not with a sequence in between that encodes for a functioning or catalytic polypeptide, protein, or protein domain.

The term "codon optimized" regarding a nucleic acid as used herein refers to the substitution of codons of the nucleic acid to enhance or maximize translation in a host of a particular species without changing the polypeptide sequence based on species-specific codon usage biases and relative availability of each aminoacyl-tRNA in the target cell cytoplasm. Codon optimization and techniques to perform such optimization is known in the art. Programs containing algorithms for codon optimization are known to those skilled in the art. Those skilled in the art will appreciate that gene expression levels are dependent on many factors, such as promoter sequences and regulatory elements. Small subsets of codons are recognized by tRNA species leading to translational selection, which can be an important limit on protein expression. In this aspect, many synthetic genes can be designed to increase their protein expression level.

As used herein, the term "split indicator" refers to a compound which may include a protein or a mimetic thereof, which is divided into two or more portions, whereby upon secondary spatial joining or separation of these portions, the split indicator assumes a three-dimensional structure which results in a measurable signal. The measurable signal may be luminescence, fluorescence, phosphoresce, and/or a drop in any one of these emissions due to quenching caused by the spatial reorientation of the compound. The measurable signal may be due to Förster resonance energy transfer (FRET) which may be used to determine if two chromophores (e.g., fluorophores) are within a certain distance of each other. As disclosed elsewhere herein, the secondary spatial joining and/or separation of these portions may be caused by the binding of an analyte molecule. A split indicator may comprise a fusion protein that is split at the indicator region or that is split at the binding region.

As used herein, the term "split luminescent protein" refers to a type of split indicator. A split luminescent protein includes a luminescent protein, the amino acid sequence of which is divided into two or more portions, whereby upon secondary spatial joining of these portions, the split luminescent protein assumes a three-dimensional structure which allows it to emit luminescence (e.g., fluorescence, phosphoresce) when excited by light of a suitable wavelength.

As used herein, the terms "protein", "polypeptide", "peptide", refer to a polymer of amino acid residues linked together by peptide bonds. A protein may have contiguous amino acid residues. The number of contiguous residues may be greater than or equal to at least: 20, 30, 40, 50, 60, 100, 200, 300, or ranges spanning and/or including the aforementioned values). A protein may be naturally occurring, recombinant, synthetic, non-natural, or any combination of these. A protein may also be just a fragment of a naturally occurring protein. The term protein may also apply to amino acid polymers in which one or more amino acid residues is an artificial chemical analogue of a corresponding naturally occurring amino acid. An amino acid polymer in which one or more amino acid residues is an "unnatural" amino acid, not corresponding to any naturally occurring amino acid, is also encompassed by the use of the term "protein" herein.

As used herein, the terms "fusion protein", "fusion polypeptide", "fusion peptide" refer to a polypeptide which comprises protein domains from at least two different proteins.

Peptides, polypeptides, and proteins are often, but not always, produced biologically by a ribosomal complex using a nucleic acid template, although chemical syntheses are also available. By manipulating the nucleic acid template, peptide, polypeptide, and protein mutations such as substitutions, deletions, truncations, additions, duplications, or fusions of more than one peptide, polypeptide, or protein can be performed. These fusions of more than one peptide, polypeptide, or protein can be joined in the same molecule adjacently, or with extra amino acids in between, e.g. linkers, repeats, epitopes, or tags, or any other sequence that is 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, or 300 bases long, or any length in a range defined by any two of the aforementioned lengths.

In some embodiments, the nucleic acid or peptide sequences presented herein and used in the examples are functional in various biological systems including but not limited to humans, mice, rabbits, bacterial, *E. coli*, fungal, yeast, insect, animal, and mammalian cells. In other embodiments, nucleic acid or peptide sequences sharing 0%, 10%, 20%, 30%, 40%, 50%, 60%, 70%, 80%, 90%, 91%, 92%, 93%, 94%, 95%, 96%, 97%, 98%, 99%, or 100% similarity, or any percentage within a range defined by any two of the aforementioned percentages similarity to the nucleic acid or peptide sequences presented herein and used in the examples can also be used with no effect on the function of the sequences in biological systems. As used herein, the term "similarity" refers to a nucleic acid or peptide sequence having the same overall order of nucleotide or amino acids, respectively, as a template nucleic acid or peptide sequence with specific changes such as substitutions, deletions, repetitions, or insertions within the sequence. In some embodiments, two nucleic acid sequences sharing as low as 0%, 10%, 20%, 30%, 40%, 50%, 60%, 70%, 80%, 90%, 91%, 92%, 93%, 94%, 95%, 96%, 97%, 98%, or 99% similarity can encode for the same polypeptide by comprising different codons that encode for the same amino acid during translation.

As used herein, the term "vector" refers to a molecule (e.g., a nucleic acid molecule) capable of transporting a nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Another type of vector is a non-viral vector, which may include a synthetic polymer configured to deliver a nucleic acid to a cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" or simply "expression vectors". In general, expression vectors of utility in recombinant DNA techniques are often in the form of plasmids. In some instances, where the term "plasmid" is used, a different "vector" may be used interchangeably as the plasmid is the most commonly used form of vector. It should be noted, other forms of expression vectors, such as viral vectors (e.g., replication defective retroviruses, adenoviruses and adeno-associated viruses) or non-viral vectors, may serve equivalent functions. Alternatively, the vectors may be liposomes into which the nucleic acid molecules or expression cassettes disclosed herein can be reconstituted for delivery to target cells. Likewise, the term "vector" refers to complexes containing such nucleic acid molecules or expression cassettes which furthermore comprise compounds that are known to facilitate gene transfer into cells such as polycations, cationic peptides and the like.

The term "recombinantly expressed" as used herein refers to the production of proteins in optimized or adapted biological systems. These systems provide advantages over protein expression in a natural host, including but not limited to high expression (overexpression), ease of purification, ease of transformation, inducibility, low cost, or stability of the protein. In some embodiments, proteins are expressed in mammalian, bacteria, yeast, insect, or cell-free recombinant expression systems. Each system has its own advantages or disadvantages. For example, bacterial expression systems are highly optimized for overexpression, but may cause misfolding or aggregation of the produced protein, yeast systems are useful when post-translational modifications are necessary, and insect and mammalian systems are useful for proper RNA splicing that occurs in higher-order organisms. In some embodiments, recombinant polypeptides are produced and purified from animal, mammalian, human, primary, immortalized, cancer, stem, fibroblasts, human embryonic kidney (HEK) 293, Chinese Hamster Ovary (CHO), bacterial, *Escherichia coli*, fungal, yeast, *Saccharomyces cerevisiae, Pichia pastoris*, insect, *Spodoptera frugiperda* Sf9, or *S. frugiperda* Sf21 cells, or in a cell-free system. In some embodiments, expression genes, vectors, or constructs are delivered to the recombinant expression systems in the form of plasmids, bacteriophages, viruses, adeno-associated viruses (AAVs), baculovirus, cosmids, fosmids, phagemids, BACs, YACs, or HACs.

As used herein, the term "luminescent compound" (e.g., a luminescent protein) refers to a compound (e.g., a protein) that absorbs energy at one wavelength and emits it at another wavelength to luminesce. A green fluorescent protein refers to, for example, a polypeptide that may have a peak at about 510 nm in its emission spectrum.

As used herein, the term "binding portion," "binding region," "binding domain," or "binding site," refers to the one or more regions of a polypeptide or mimetic thereof that mediates specific binding with a target molecule (e.g. a sugar or other molecule, or other agent, NADPH, heavy metals, $Ca^{2+}$). Exemplary binding domains include a receptor binding domain of a ligand, a ligand binding domain of a receptor or an enzymatic domain. The binding region may refer to any native receptor (e.g., cell surface receptor) or any region or variant thereof retaining at least a qualitative ligand binding ability, and in some embodiments the biological activity of a corresponding native receptor. The binding region may refer to any native ligand or protein (e.g., the receptor of a periplasmic membrane protein) or any region or variant thereof retaining at least a qualitative receptor binding ability, and in some embodiments the biological activity of a corresponding native ligand. In some embodiments, the polypeptides or mimetics (e.g., mimics) thereof have at least one binding domain specific for a molecule targeted for quantification, reduction, or elimination.

As used herein, the term "signaling portion," "signaling region," or "signaling domain," refers to the one or more regions of a polypeptide or mimetic thereof that provide a measurable signal in response to the binding of an analyte to a binding portion. The signaling region may refer to any native protein or any region or variant thereof retaining at least a qualitative signaling ability, and in some embodiments the biological activity of a corresponding native signaling molecule.

As used herein, the terms "linker" refers to a unit present within the fusion proteins which comprises a spacer between, for example, the binding portion of an analyte binding protein and an signaling protein. The linker may, in some embodiments, comprise a length of repeat residues of G and/or S amino acids (with a number of repeating residues that is equal to or greater than about: 3, 5, 10, 15, 20, or ranges including and/or spanning the aforementioned values). A linker may bind an signaling unit of a fusion protein to a binding region of the fusion protein.

As used herein, the term "small molecule" refers to a non-nucleotidyl and non-protein, distinct organic compound with a molecular weight lower compared to the molecular weight of biomolecules. A small molecule may have a molecular weight of less than or equal to about: 900 Daltons, 1500 Daltons, 2000 Daltons, 5000 Daltons, or ranges including and/or spanning the aforementioned values. The average size of a small molecule may be on the order of less than or equal to about: 1 nm, 2 nm, 3 nm, or ranges including and/or spanning the aforementioned values.

As used herein, the term "variant" may be used interchangeably with the term "mutant." "Variants" can refer to either polypeptides or nucleic acids. Variants include one or more sequence "modifications," which as used herein include substitutions, insertions, deletions, truncations, transversions, and/or inversions, at one or more locations relative to a reference sequence. Each modifications can include changes that result in a change of one or more amino acid residues or nucleotides in a sequence, relative to the reference sequence. Variant nucleic acids include sequences that are complementary to sequences that are capable of hybridizing to the nucleotide sequences presented herein. For example, a variant nucleic acid sequence herein can be at least partially complementary to a sequence capable of hybridizing under stringent conditions to a nucleotide sequences presented herein. A variant can have a sequence that is equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% identical to that of the disclosed protein or nucleotide and/or to the active region of the disclosed protein (or ranges including and/or spanning the aforementioned values). A variant can have a sequence that shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% homology or similarity to that of the disclosed protein or nucleotide and/or to the active region of the disclosed protein (or ranges including and/or spanning the aforementioned values).

As used herein, "in vivo" is given its ordinary meaning and refers to the performance of a method inside living organisms, usually animals, mammals, including humans, and plants, as opposed to a tissue extract or dead organism.

As used herein, "ex vivo" is given its ordinary meaning and refers to the performance of a method outside a living organism with little alteration of natural biology.

As used herein, "in vitro" is given its ordinary meaning and refers to the performance of a method outside of biological conditions, e.g., in a petri dish or test tube.

Any titles or subheadings used herein are for organization purposes and should not be used to limit the scope of embodiments disclosed herein.

The term "truncated" means a deletion of one or a few amino acid residues at the N- and/or C-terminus or internal amino acid residues of one or both signaling portion(s) and/or the binding portion compared to the corresponding wild-type protein. In particular, the truncated region(s) comprise equal to or at least about: 1, 2, 5, 10, 20 (or ranges spanning and/or including any of the aforementioned values) amino acid residues. The extent of truncation may be limited to a maximum where the protein portions still show their functions necessary for the fusion protein to measure analyte concentration.

The term "wild-type" refers to the protein that has been used as the starting point for constructing the fusion protein of the invention.

The term "increased insensitivity to the pH value" means that the difference between maximum energy emission of the fusion proteins (for example at around pH 6.0 to 6.5) and the lowest energy emission observed within the physiological pH range (e.g., between pH 5.5 and pH 8.5), under otherwise substantially identical conditions is reduced by equal to or at least about: 20%, 50%, 80%, 90%, or ranges spanning and/or including any of the aforementioned values.

The term "increased insensitivity to the temperature value" means that the difference between maximum energy emission of the fusion proteins and the lowest energy emission observed within the between 15° C. and 30° C., under otherwise substantially identical conditions is reduced by equal to or at least about: 20%, 50%, 80%, 90%, or ranges spanning and/or including any of the aforementioned values.

The term "increased stability" means that the protein has enhanced stability relative to a comparator protein (including comparator proteins that are native proteins of from which a variant with increased stability is derived). In several embodiments, stability (e.g., activity under an environmental given condition) is increase by equal to or at least about: 20%, 50%, 80%, 90%, 100%, or ranges spanning and/or including any of the aforementioned values. Environmental conditions where increased stability may be shown include conditions such as buffered solutions (such as phosphate buffered saline, HEPES buffer, tris buffer, etc.), blood and/or blood plasma (including fetal bovine serum), and in vivo conditions (such as the subcutaneous environment of, for example, the dermis). Enhanced stability may be demonstrated at elevated temperatures 30° C. (e.g., in an aforementioned solution) and at elevated or reduced pH (in aqueous solution, isotonic solution, etc.). Reduced pH conditions may include pH values equal to or less than 4, 5, 6, or ranges spanning and/or including the aforementioned values. Elevated pH conditions may include pH values equal to or at least about 8, 9, 10, or ranges spanning and/or including the aforementioned values.

Introduction

Glucose is essential for cell growth, proliferation, and homeostasis and is one of the most common energy fuels for the body. Glucose circulates throughout the body via the blood, and the blood glucose level is controlled by hormones, such as insulin and glucagon. See Mita, M. et al. *Green Fluorescent Protein-Based Glucose Indicators Report Glucose Dynamics in Living Cells*, Anal. Chem. 2019, 91, 4821-4830. Cells take in glucose from the blood in response to insulin and metabolize it to provide energy. Glucose is metabolized to adenosine triphosphate (ATP) by glycolysis and electron transfer or is converted into glycogen for energy storage. Pancreatic β-cells (beta cells) sense increases in glucose levels in the blood following food intake and uptake glucose via the glucose transporters (such as GLUTs in mammals). The primary function of a beta cell is to produce and release insulin and amylin. Both are hormones which reduce blood glucose levels by different mechanisms. Beta cells can respond quickly to spikes in blood glucose concentrations by secreting some of their stored insulin and amylin while simultaneously producing more.

Failures in the glucose metabolic pathway can cause chronic diseases, such as diabetes mellitus or obesity that affect a large proportion of the population. Type 1 diabetes mellitus, also known as insulin dependent diabetes, is believed to be caused by an auto-immune mediated destruction of the insulin producing beta cells in the body. The destruction of these cells reduces the body's ability to respond to glucose levels in the body, therefore making it nearly impossible to properly regulate glucose and glucagon levels in the bloodstream. Type 2 diabetes mellitus, also known as non-insulin dependent diabetes and as chronic hyperglycemia, is caused primarily by genetics and the development of metabolic syndrome. The beta cells can still secrete insulin but the body has developed a resistance and its response to insulin has declined. In an effort to secrete enough insulin to overcome the increasing insulin resistance, the beta cells increase their function, size and number. Increased insulin secretion leads to hyperinsulinemia, but blood glucose levels remain within their normal range due to the decreased efficacy of insulin signaling. However, the beta cells can become overworked and exhausted from being overstimulated, leading to a 50% reduction in function along with a 40% decrease in beta-cell volume. At this point, not enough insulin can be produced and secreted to keep blood glucose levels within their normal range, causing overt type 2 diabetes. This can cause the patient to experience hyperglycemia, which leads to other adverse short-term and long-term conditions. This makes it important to understand the mechanisms of glucose metabolism and/or to monitor glucose levels in living cells and/or patients at a high spatiotemporal resolution.

There remains a need for glucose monitoring that is real-time, highly accurate, that allow single or dual compound emissions to visualize one molecule, and that have improved lifetimes (e.g., stability and accuracy over time). Moreover, invasive forms of self-testing are painful and fraught with a multitude of psychosocial hurdles, and are resisted by most diabetics. Additionally, where continuous monitoring is performed with a unit that is worn on the body, needles and components have a limited lifetime requiring replacement or yielding inaccurate results. Also of use would be monitoring systems for other biological analytes, as disclosed elsewhere herein. Some embodiments disclosed herein provide solutions to these problems or others. Some embodiments provide indicator compounds and/or devices comprising indicator compounds for the monitoring of analytes (including but not limited to glucose) in a subject (e.g., a patient).

Indicator Compounds

Figure 1B:
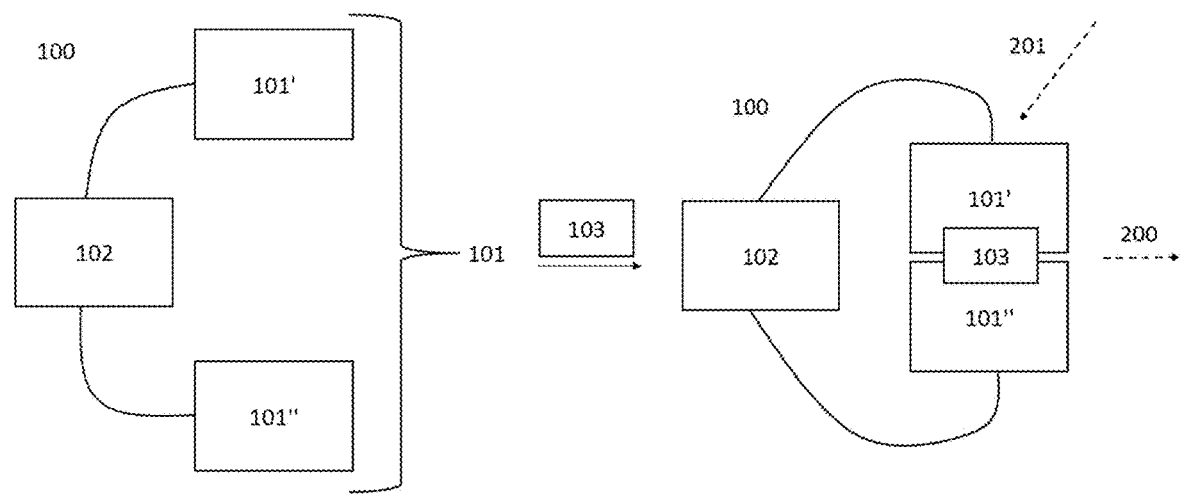

Some embodiments disclosed herein pertain to indicator compounds for use in detecting an analyte and/or one or more analytes. In some embodiments, as shown in FIGS. 1A and 1B, an individual indicator compound 100 may comprise a binding region 101 and a signaling region 102. As shown in FIG. 1A, the signaling region 102 may be split and/or may comprise a plurality of signaling units 102', 102" (e.g., 2, 3, 4, 5, or more). As shown, in some embodiments, when an analyte 103 binds to a binding region 101 of the indicator compound, a conformational shift in the signaling region 102 of the compound 100 occurs, resulting in a detectable signal 200. In several embodiments, the signaling units 102', 102" are brought into proximity to provide an active signaling region that produces the detectable signal 200. In some embodiments, the detectable signal 200 is generated when the indicator compound is interrogated (e.g., excited) with an excitation wavelength 201. In some embodiments, the signaling region, and/or signaling units comprising the signaling region (e.g., portions of the signaling region that provide the signaling region), comprises, consists of, or consists essentially of a luminescent protein and/or portions of a luminescent protein. In other embodiments, the signaling units comprise small molecule chromophores (or pieces thereof).

As shown in FIG. 1B, the binding region 101 may be split and/or may comprise a plurality of binding units 101', 101" (e.g., 2, 3, 4, 5, or more). As shown, in some embodiments, when an analyte 103 binds to the binding region 101 of the indicator compound, a conformational shift in the signaling region 102 of the compound 100 occurs, resulting in a detectable signal 200. In some embodiments, the detectable signal 200 is generated when the indicator compound is interrogated (e.g., excited) with an excitation wavelength 201. In some embodiments, the binding region, and/or binding units comprising the binding region (e.g., portions of the binding region that provide the binding region), comprises, consists of, or consists essentially of an analyte binding protein and/or portions of an analyte binding protein. In other embodiments, the binding region or binding units comprise non-protein based receptors for the analyte.

In some embodiments, as disclosed elsewhere herein, the indicator compound may be introduced into a sensor device. In some embodiments, multiple analytes (e.g., 2, 3, 4, 5, or more) may be measured by using a single sensor by introducing more than one type of indicator compound into the sensor. Alternatively or additionally, in some embodiments, multiple analytes (e.g., 2, 3, 4, 5, or more) may be measured by using a single indicator compound that has multiple analyte binding regions for multiple analytes, respectively. In some embodiments, where multiple analytes are to be monitored by a single sensor device, the indicator compounds may be selected to have measurable emission spectra that are distinguishable depending on the indicator type. For instance, one indicator compound may be used to monitor glucose. A separate indicator compounds may used to monitor cholesterol. Those indicator compounds can be designed to be used together in a device when the indicator compounds give distinguishable emission signals (and/or signals that do not interfere with each other).

As disclosed elsewhere herein, FIG. 1A provides an example of one type of indicator compound. In several embodiments, the indicator compound, such as the one pictured in FIG. 1A (or FIG. 1B), may be a fusion protein that includes a domain of a binding protein (e.g., an analyte binding protein) and a domain of a signaling protein (e.g., a luminescent protein). As shown in FIG. 1A or FIG. 1B, in some embodiments, when an analyte 103 (e.g., glucose) is bound to the indicator compound 100, a measurable and/or quantifiable signal 200 is produced (e.g., upon excitation). In some embodiments, for example, when an analyte (e.g., glucose) is bound, the indicator compound absorbs light having a maximum at a first wavelength and emits light having a maximum at a second, different wavelength. Alternatively, in some embodiments, the binding of glucose (or some other analyte) to the indicator compound results in the lowering of an emitted signal (e.g., quenching) or some other change in a signal from the indicator compound (e.g., a change in emission signal, a change in absorption signal, etc.) that allows quantification of the amount of binding to the indicator compound 100. In some embodiments, the binding of glucose (or some other analyte) to the indicator compound results in the increase in an emitted signal or some other change in a signal from the indicator compound (e.g., an increase or decrease in emission signal, an increase or decrease in absorption signal, etc.). As disclosed elsewhere herein, the measurable signal (e.g., provided upon binding of an analyte) may be luminescence, fluorescence, phosphoresce, and/or a drop in any one of these emissions due to quenching caused by the spatial reorientation of the compound.

In some embodiments, as shown in FIG. 1A and FIG. 1B, the indicator compound may be a split indicator. In some embodiments, using FIG. 1A as an example, the two arms 102', 102" of the split indicator may be terminated with portions of a signaling protein and/or differing chromophores, luminophores, fluorophores, or combinations thereof that result in different signals (e.g., through quenching, a change in emission signal, a change in absorption signal, etc.) when an analyte is bound or not bound. In some embodiments, the split indicator may be a fusion protein. In some embodiments, where the indicator compound is a fusion protein, the two arms 102', 102" may comprise portions of a luminescent protein (e.g., a fluorescent protein) that undergo a conformational change when an analyte 103 binds to a receptor portion 101 (e.g., binding portion) of the indicator compound 100. In some embodiments, as shown, the binding of the analyte to the receptor portion 101 (e.g., binding portion) of the indicator compound results in a measurable signal 200. In several embodiments, as disclosed elsewhere herein, the measurable signal may be one or more of luminescence (e.g., fluorescence). In other embodiments, the two arms may comprise small molecule synthetic or naturally occurring chromophores, as disclosed elsewhere herein.

As shown in FIG. 1A, indicator compound may include a domain of a binding protein (a binding portion of the indicator compound) that is inserted into the domain of a signaling protein (a signaling portion of the indicator compound), thereby splitting the signaling protein. In some embodiments, alternatively and as shown in FIG. 1B, a split indicator may have a configuration where the signaling domain of the fusion protein (the signaling portion of the indicator compound) splits the domain of the binding protein (the binding portion of the indicator compound). As will be appreciated by a person of skill in the art and as disclosed elsewhere herein, while fusion proteins are used as examples here, other configurations may be used, including those lacking protein domains and/or those comprising a mixture of non-protein (e.g., small molecule chromophores) and protein domains. For example, the split indicator may comprise fluorescent small molecules or portions thereof (FRET or other signaling molecules, fluorophores, etc.) that are separated by a binding domain of a binding protein. Alternatively, the binding domain may simply be a receptor for an analyte and may not include a protein domain. In such an embodiment, the signaling portion may or may not include a signaling protein domain. Thus, the indicator compound could be lack protein domains altogether in certain embodiments.

As shown in FIG. 1A and as disclosed elsewhere herein, the indicator compound may include a binding portion that undergoes a conformational change (e.g., a change in three dimensional structure) in response to the binding of an analyte that activates (e.g., by bringing into proximity) the indicator portion(s) 102', 102" of the indicator compound, thereby producing a measurable signal. Conversely, as shown in FIG. 1B, in some embodiments, the individual indicator compound 100 may comprise a binding portion that is split into a plurality of binding units 101', 101" (e.g., 2, 3, 4, 5, or more). In some embodiments, the indicator comprises a signaling region 102. As shown, in some embodiments, when an analyte 103 binds to a binding region of the indicator compound, a conformational shift may occur (e.g., either in the binding region or the signaling region) resulting in a detectable signal 200.

In some embodiments, the indicator compound is not a split indicator, as shown in, for example, FIG. 1C. As shown in FIG. 1C, the indicator compound 300 may comprise a binding region 301 and a signaling region 302. The binding region 302 may comprise a plurality of signaling units 302', 302" (e.g., 2, 3, 4, 5, or more). As shown, in some embodiments, when an analyte 303 binds to the binding region 301 of the indicator compound 300, a conformational shift in the signaling region 302 (and/or the binding region) of the compound may occur, resulting in a detectable signal 200.

As disclosed elsewhere herein, in some embodiments, the indicator compound is a fusion protein. In some embodiments, the fusion proteins may comprise a full-length or a binding portion of an analyte binding protein operably linked to a full-length or active portion (e.g., a luminescent portion) of a luminescent protein. For example, in some embodiments, the indicator compounds comprise a glucose binding region operably linked (e.g., by a linker) to a fluorescent protein or fluorescing portion of a protein. In some embodiments, the binding region comprises D-galactose/methyl-galactoside ABC transporter periplasmic binding protein (MglB) or a glucose binding portion thereof. In some embodiments, an indicator compound may comprise a full-length fluorescent protein (FP) or a fluorescing fragment or portion thereof. In some embodiments, upon binding of glucose within or near the glucose binding region, when exposed to light, the luminescent protein (e.g., FP or fluorescing portion thereof) is activated and luminesces (e.g., fluoresces) at a different wavelength of light. In some embodiments, the fluorescence of the luminescent protein (e.g., FP or fluorescing portion) thereof allows detection and/or quantification of the amount of analyte (e.g., glucose) present in a sample. In some embodiments, as disclosed elsewhere herein, the fusion proteins may comprise active fragments of an analyte binding protein operably linked to active fragments (e.g., a luminescent portion) of a luminescent protein. In some embodiments, as disclosed elsewhere herein, the fusion proteins may comprise variants of an analyte binding protein (or fragment thereof) operably linked to active (e.g., a luminescent portion) variants of a luminescent protein (or fragments thereof).

As disclosed elsewhere herein, in some embodiments, the indicator compound comprises a split luminescent protein. In some embodiments, the glucose binding region of the indicator compound is placed in between the two portions of the split luminescent protein. For example, a fluorescent protein may be a split fluorescent protein, whereby upon binding of an analyte, secondary spatial joining of these fluorescent protein portions occurs, which allows the indicator compound to emit fluorescence when excited by light of a suitable wavelength. As disclosed elsewhere herein, in some embodiments, the indicator compound comprises a split binding protein. In some embodiments, the binding region of the indicator compound is split by a luminescent protein. For example, a binding protein may be a split binding protein, whereby upon binding of an analyte, secondary spatial joining of these binding portions occurs, which allows the indicator compound to emit fluorescence when excited by light of a suitable wavelength. In some embodiments, the indicator compound comprises a luminescent protein that is not split. In some embodiments, the indicator compound comprises a binding protein that is not split.

In some embodiments, the compound is a single-(FP)-type indicator. In some embodiments, these indicators advantageously may image one, two, or more molecules (e.g., in vitro, in vivo, in the dermis, in single cells, etc.). In some embodiments, single-FP-type glucose indicators can be used to measure glucose concentrations in vitro or in vivo with one signal. For example, where a cell or cells comprise the indicator compound, an intensity of a signal from the indicator compound (or drop in intensity of a signal) can be indicative of the quantity of analyte present. In some embodiments, the single-FP-type glucose indicators as disclosed herein are suitable for live-cell imaging of mammalian cells or multi-color imaging of glucose dynamics in conjunction with other molecules.

In some embodiments, an indicator compound as disclosed herein may be a Förster resonance energy transfer (FRET) based indicator. In other embodiments, the indicator compound is not a FRET-based indicator. Förster resonance energy transfer (FRET)-type glucose indicators may reveal the affinity of each glucose transporter to glucose regulates distinct basal intracellular glucose levels in living cells, and that each organelle maintains its own required glucose level. FRET indicators (or other indicator compounds as disclosed herein) can be applied not only to mammalian cells and/or organisms but also to plants and the Drosophila brain in vivo to better understand glucose dynamics in different contexts (as can the other indicator compounds disclosed herein). Indicator compounds (including FRET indicators) may employ or may be used in conjunction to provide two emissions to visualize one molecule. For instance a single indicator compound with multiple fluorophores and/or multiple binding regions may provide two signals indicative of an analyte. Alternatively, two different types of indicator compounds that bind the same analyte can be employed to provide two measures of the presence of that single analyte.

As disclosed elsewhere herein, the indicator compound may comprise a luminescent protein (e.g., a split luminescent protein or a luminescent protein that is not split). For example, the indicator compound comprise a bioluminescent protein. In some embodiments, the luminescent protein is a phosphorescent protein or a fluorescent protein. Alternatively, or additionally, the indicator compound may comprise a luminescent domain, fragment, or portion of a luminescent protein (e.g., an operative portion of a luminescent protein). For brevity, the term protein is often used herein to describe luminescent regions or binding regions. Any example used with reference to a protein should also be understood to be applicable to a domain, fragment, or portion of that protein (e.g., an operative portion of a luminescent protein), or a non-protein mimic or small molecule having the function of that protein (e.g., a small molecule fluorophore).

In some embodiments, the signal emitting portion of the indicator compound (e.g., the luminescent protein domain) comprises one or more of a yellow fluorescent protein (YFP), enhanced YFP (EYFP), Topaz, Venus, Citrine, YPet, SYFP, mAmetrine, TagYFP, TurboYFP, ZsYellow, PhiYFP, a green fluorescent protein (GFP), enhanced GFP (EGFP), Emerald, T-Sapphire, superfolder GFP (sfGFP), Azami Green, mWasabi, ZsGreen, TagGFP, TagGFP2, TurboGFP, CopGFP, AceGFP, a blue fluorescent protein (BFP), enhanced BFP (EBFP), Azurite, strongly enhanced BFP (SBFP2), EBFP2, Sirius, mTagBFP, a cyan fluorescent protein (CFP), enhanced CFP (ECFP), Cerulean, CyPet, SCFP, TagCFP, AmCyan, Midoriishi Cyan, mTFP1, an orange fluorescent protein, Kusabira Orange, Kusabira Orange2, mOrange, mOrange2, dTomato, dTomato-Tandem, DsRed, DsRed2, DsRed-Express, DsRed-Express2, DsRed-Max, DsRed-Monomer, TurboRFP, TagRFP, TagRFP-T, a red fluorescent protein (RFP), mRuby, mApple, mStrawberry, AsRed2, mRFP1, JRed, mCherry, eqFP611, tdRFP611, HcRed1, mRaspberry, a far-red fluorescent protein, tdRFP639, mKate, mKate2, Katushka, HcRed-Tandem, mPlum, or AQ143, a photoactivatable fluorescent protein, PA-GFP, PS-CFP2, PA-mRFP1, PA-mCherry1, Phamret, a photoconvertible fluorescent protein, Kaede, wtKikGR, mKikGR, wtEosFP, dEos, mEos2, Dendra2, a photoswitchable fluorescent protein, Dronpa, Dronpa-3, rsFastLine, Padron, bsDronpa, KFP1, mTFP0.7, E2GFP, rsCherry, rsCherryRev, a photoconvertible/photoswitchable fluorescent protein, IrisFP, or another fluorescent protein, luminescing or fluorescing fragments of any of the foregoing, portions of any of the foregoing, or variants of any of the foregoing.

Several signal emitting proteins are provided in FIGS. 6A(1)-6A(54). In some embodiments, the signal emitting portion of the indicator compound (e.g., the luminescent protein domain) may be selected from a variety of luminescent proteins, such as those shown in FIGS. 6A(1)-6A(54). In some embodiments, the signal emitting portion of the indicator compound (e.g., the luminescent protein domain) comprises mPapaya, mPapaya0.7, mPapaya0.6, mPapaya0.3, dPapaya0.1, tPapaya0.01, ZsYellow1, zFP538, TDsmURFP, smURFP, R3-2+PCB, TeAPCα, miRFP702, miRFP670-2, iRFP670. iRFP702, RpBphP6, miRFP713, miRFP680, iRFP713/V256C, miRFP720, iRFP720, miRFP682, iRFP682, iRFP713, RpBphP2, emiRFP670, miRFP709, emiRFP703, miRFP703, miRFP670, miRFP670v1, miRFPm RpBphP1, miRFP670nano, NpR3784g, mScarlet-I, mScarlet-H, mScarlet, mRed7Q1S1BM, mRed7Q1S1, mRed7Q1, mRed7, mKeima, dKeima570, dKeima, tKeima. Montipora sp. #20-9115, Montipo, ra sp. #20, moxNeonGreen, mNeonGreen. dLanYFP, LanYFP, mKOx, mKO2, mK-GO, mKO, KO, mKikGR, KikGR1, KikG, HcRed1-Blue, mGinger2, mGinger1, HcRed7, HcRed, td-RFP611, RFP611, mGarnet2, mGarnet, mRuby3, mRuby2, mRuby, d-RFP618, td-RFP639, RFP639, RFP637, RFP618, RFP630, eqFP611, rsTagRFP, mKate S158A, mKate M41G S158C, mKate S158C, rsFusionRed3, rsFusionRed2, rsFusionRed1, FR-1, FusionRed-M, FusionRed, mKate2.5, cgfmKate2, mStable, mKate2, mBeRFP, LSS-mKate2, LSS-mKate1, PAmKate, TagRFP657, mCarmine, mNeptune684, mNeptune681, mMaroon1, Maroon0.1, mCyRFP1, CyRFP1, CyOFP1, mNeptune2.5, mKelly2, mKelly1, mCardinal, mNeptune2, mNeptune, Neptune, mKate, cgfTagRFP, PATagRFP, mTagBFP2, TagBFP, TagRFP-T, TagRFP, Katushka2S, eqFP670, eqFP650, Katushka-9-5, Katushka, TurboRFP, eqFP578, risFP-M159A, risFP, mEosFP-F173S, mEosFP-M159A, mIrisFP, mEos2-A69T, Skylan-NS, Skylan-S, mEos3.1, mEos4b, moxEos3.2, mEos3.2, mEos2-NA, mGeos-C, mGeos-F, mGeos-L, mGeos-E, mGeos-S, mGeos-M, mEos4a, mEos2, mEosFP, d2EosFP, d1EosFP, EosFP, DsRed-Timer, DsRed2, DsRed.M1, DsRed.T4, DsRed.T3, sfCherry3C, sfCherry2, sfCherry, PAmCherry3, PAmCherry2, RDSmCherry1, RDSmCherry0.5, RDSmCherry0.2, RDSmCherry0.1, mCherry1.5, rsCherryRev1.4, rsCherryRev, rsCherry, PAmCherry1, mCherry2, mCherry, mRFP1.5, mOFP.T.12, mStrawberry, mOrange2, pHuji, mApple, LSSmOrange, PSmOrange2, PSmOrange, mOrange, mOFP.T.8, mRFP1.4. mRFP1.3, mBanana, mTangerine, mRaspberry, mPlum-E16P, mPlum, mRFP1.2, mHoneydew, mGrape3, mGrape2, mGrape1, mRFP1.1, mRFP1, dTG, RRvT, tdTomato, dTomato, dimer2, dimer1, E2-Red/Green, E2-Orange, E2-Crimson, DsRed-Max, DsRed-Express2, DsRed-Express, DsRed, iFP2.0, iFP1.4, DrCBD, Gamillus. Gamillus0.5, Gamillus0.4, Gamillus0.3, Gamillus0.2, Gamillus0.1, dfGFP, Dendra2-T69A, Dendra2-M159A, NijiFP, moxDendra2, Dendra2, Dendra, dendFP. moxMaple3, mMaple3, mMaple2, mMaple, mClavGR2, mClavGR1.8, dClavGR1.6, mClavGR1.1, mClavGR1, mWasabi, G3, G2, G1, mTFP1, mTFP0.9, mTFP0.8, mTFP0.7, mTFP0.6, mTFP0.5, mTFP0.4, mTFP0.3, dTFP0.2, dTFP0.1, cFP484, mAvicFP1, AvicFP1, pHluorin ecliptic, pHluorin2, pHluorin ratiometric, 10B, mPA-GFP, PA-GFP, Topaz, mClover1.5, dClover2 A206K, mClover3, dClover2, Clover1.5, Clover, mT-Sapphire, T-Sapphire, Sapphire, mEYFP, YFP3, EYFP-F46L, SHardonnay, Achilles, moxVenus, oxVenus, mVenus-Q69M, SYFP2, SGFP2(T65G), SGFP2(E222Q), SGFP2(206A), cfSGFP2, SGFP2, SGFP1, mTurquoise-146S, mTurquoise-146G, Superfolder mTurquoise2 ox, Superfolder mTurquoise2, mTurquoise2-G, mTurquoise2, mTurquoise-RA, mTurquoise-GV, mTurquoise-GL, mTurquoise-DR, mTurquoise, SCFP3B, SCFP3A, SCFP2, SCFP1, SBFP2, SBFP1, mVenus, YPet, Venus, SEYFP, EYFP-Q69K, Citrine2, mCitrine, SPOON, Dreiklang, Citrine, EYFP, 11, GFPmut3, GFPmut2, RSGFP7, RSGFP6, RSGFP4, RSGFP3, RSGFP2, RSGFP1, W1C, ECFP H148D, mECFP, D10, CyPet, NowGFP, WasCFP, mCerulean.B24, mCerulean.B2, mCerulean.B, mCerulean2.D3, moxCerulean3, mCerulean3, mCerulean2.N(T65S), mCerulean2.N, mCerulean2, mCerulean, Cerulean, CFP4, Aquamarine, ECFP, W7, W2, CFP, rsFolder2, rsFolder, vsfGFP-0, muGFP, usGFP, vsGFP, moxGFP, oxGFP, vsfGFP-9, Superfolder GFP, Folding Reporter GFP, aGFP, BrUSLEE, SiriusGFP, mEmerald, Emerald, mKalama1, rsEGFP2, rsEGFP, mEGFP, mAmetrine, EGFP, P9, P11, H9, sg50, sg42, sg25, sgl2, sg11, Q80R, moxBFP, oxBFP, EBFP2, EBFP1.5, EBFP1.2, EBFP, BFP.A5, Azurite, BFP, BFP5, P4, avGFP, mKillerOrange, KillerOrange, A44-KR, SuperNova Green, SuperNova Red, KillerRed, anm2CP, amFP515, amFP506, amFP495, amFP486, PS-CFP2, PS-CFP, aceGFP, rsKame, Padron(star), Kohinoor, Padron0.9, Padron, bsDronpa, rsFastLime, pcDronpa2, pcDronpa, ffDronpa, PDM1-4, Dronpa-C62S, Dronpa-3, Dronpa-2, Dronpa, 22G, luminescing or fluorescing fragments of any of the foregoing, portions of any of the foregoing, or variants of any of the foregoing.

In some embodiments, any luminescent protein, phosphorescent protein, or fluorescent protein disclosed herein may be circularly permuted. For example, cpYFP (SEQ ID NO: 14) is a circularly permuted form of EYFP by splitting the peptide sequence at a permissible region (e.g. between N144 and Y145 of EYFP) and swapping the N-terminal and C-terminal domains, optionally with a linker, such as a linker of 1, 2, 3, 4, 5, 6, 7, 8, 9, or 10 amino acids. In some embodiments, the luminescent protein or luminescent domains, fragments, or portions thereof are truncated or extended (e.g., with a linker) at the N-terminus and/or C-terminus by a number of amino acids, such as 1, 2, 3, 4, 5, 6, 7, 8, 9, or 10 amino acids.

As disclosed elsewhere herein, in some embodiments, fusion proteins comprising a binding protein portion (e.g., a binding domain) between the two detection portions (e.g., a signaling domain). In other embodiments, the binding protein portion (e.g., the binding domain) may be split by a detection portion (e.g. a signaling domain). In some embodiments, upon binding of an analyte (e.g., glucose), the indicator compound undergoes a conformational change. In some embodiments, this conformational change is responsible for the signal produced by the indicator compound (e.g., the fusion protein).

In some embodiments, where identity, homology, or similarity are described elsewhere herein, such identity, homology, or similarity levels may be applied to an individual protein of a split fusion protein (e.g., a split indicator or a split luminescent compound). To illustrate, a split fusion protein may comprise two proteins and one of those proteins may be embedded within the other protein. As used herein, where a citrine protein of SEQ ID NO:1 is split by the Mg1B protein of SEQ ID NO:2, the split citrine indicator portion (e.g., the split signaling domain of the indicator compound) can nonetheless be expressed as having a percent identity to the unsplit citrine protein. For example, the split citrine indicator can be expressed as having 100% identity to SEQ ID NO:1 where each amino acid of the split signaling domain coincides to each amino acid of SEQ ID NO:1, but for the split by SEQ ID NO:2. As another example, where the citrine protein of SEQ ID NO:1 splits the Mg1B protein of SEQ ID NO:2, the split binding protein (e.g., the binding domain of the indicator compound) can be expressed as having 100% identity to SEQ ID NO:2 where each amino acid of the split binding protein coincides to each amino acid of SEQ ID NO:2, but for the split by SEQ ID NO:1.

In some embodiments, the fusion protein comprises one or more of a citrine sequence and/or a circularly permuted yellow fluorescent protein (cpYFP) sequence as shown in FIG. 2A (e.g., SEQ ID NO: 1) and FIG. 3A (e.g., SEQ ID NO: 14), respectively. In other embodiments, other fluorescent and/or luminescent proteins are used (including circularly permuted versions of those proteins) such as those disclosed in FIGS. 6A(1)-6A(54) and FIGS. 7A(1)-7A(88) (e.g., SEQ ID NOs: 34-122) (as well as variants of any of the foregoing).

In some embodiments, the signaling domain of the indicator compound has a sequence that is identical to that of any one of SEQ ID NOs: 1, 14, 34-121 (as shown in the figures), and/or 222-823. In some embodiments, the signaling domain has a sequence that is a variant of any one of SEQ ID NOs: 1, 14, 34-121, and/or 222-823. In some embodiments, the signaling domain has a sequence that is independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, 100% (or ranges including and/or spanning the aforementioned values) identical to that of any one of SEQ ID NOs: 1, 14, 34-121, and/or 222-823. In some embodiments, the signaling domain has a sequence that independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) homology or similarity to that of any one of SEQ ID NOs: 1, 14, 34-121, and/or 222-823. In some embodiments, the signaling proteins or signaling domains, fragments, or portions thereof may be truncated or extended (e.g. with a linker) at the N-terminus and/or C-terminus by a number of amino acids, such as 1, 2, 3, 4, 5, 6, 7, 8, 9, or 10 amino acids.

In some embodiments, a contiguous portion of the signaling domain of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identity, homology, and/or similarity to a contiguous portion of one or more of SEQ ID NOs: 1, 14, 34-121, and/or 222-823. In some embodiments, a contiguous portion of the signaling domain of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identity, homology, and/or similarity to a contiguous portion of one or more of SEQ ID NOs: 3-13 and/or 16-20. In some embodiments, the contiguous portion of the indicator compound may include the entire signaling domain, one or more fragments of the signaling domain (e.g., luminescing fragments), and/or a signaling unit of the signaling domain. In some embodiments, the contiguous portion of the indicator compound and/or the contiguous portion of one or more of SEQ ID NOs: 1, 2, 14, 15, 34-121, and/or 222-823 is equal to or at least about: 200, 100, 80, 60, 50, 40, 30, 20, or 10 amino acids in length (or ranges including and/or spanning the aforementioned values).

In several embodiments, the indicator compound may comprise multiple (two, three, four, etc.) contiguous portions that share the aforementioned identity values, homology values, or similarity values to contiguous portions of SEQ ID NOs: 1, 2, 14, 15, 34-121, and/or 222-823. To illustrate, the indicator compound may comprise a first contiguous portion 100 amino acids in length and that is between 80% and 100% homologous to a contiguous portion 100 amino acids in length of SEQ ID NO:1. Additionally, that indicator compound could comprise a second, different contiguous portion that is 80 amino acids in length and that is 100% identical to a second, different contiguous portion of SEQ ID NO:1 that is 80 amino acids in length.

In some embodiments, the contiguous portion of one or more of SEQ ID NOs: 1, 2, 14, 15, 34-121, and/or 222-823 optionally has 1, 2, 3, 4, 5, 6, 7, 8, 9, 10, or 20 amino acid differences relative to the contiguous portion of the indicator compound. In some embodiments, the amino acid differences include insertions, deletions, and/or substitutions. In some embodiments, the substitutions can include a substitution of any one or more of amino acids for other amino acids. In some embodiments, amino acid substitutions are conservative or non-conservative (radical). A conservative replacement (also called a conservative mutation or a conservative substitution) is an amino acid replacement in a protein (e.g., of the luminescent protein) that changes a given amino acid to a different amino acid with similar biochemical properties (e.g. charge, hydrophobicity and size). Three and single letter abbreviations for natural α-amino acids used throughout are as follows:

| Amino acid | Abbreviation | Abbreviation |
| --- | --- | --- |
| α-Amino butyric acid | Abu | — |
| Alanine | Ala | A |
| Arginine | Arg | R |

-continued

| Amino acid | Abbreviation | Abbreviation |
|---|---|---|
| Aspartic acid | Asp | D |
| Asparagine | Asn | N |
| Cysteine | Cys | C |
| Glutamic acid | Glu | E |
| Glutamine | Gln | Q |
| Glycine | Gly | G |
| Isoleucine | Ile | I |
| Histidine | His | H |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

There are 20 naturally occurring amino acids. Some of these share similar characteristics (are conservative). For example, leucine and isoleucine are both aliphatic, branched hydrophobes. Similarly, aspartic acid and glutamic acid are both small, negatively charged residues. Although there are many ways to classify amino acids, they are often sorted into six main classes on the basis of their structure and the general chemical characteristics of their side chains (R groups).

TABLE 1

| Class | Amino acids | 1-letter code |
|---|---|---|
| Aliphatic | Glycine, Alanine, Valine, Leucine, Isoleucine | G, A, V, L, I |
| Hydroxyl or sulfur/selenium - containing | Serine, Cysteine, Selenocysteine, Threonine, Methionine | S, C, U, T, M |
| Cyclic | Proline | P |
| Aromatic | Phenylalanine, Tyrosine, Tryptophan | F, Y, W |
| Basic | Histidine, Lysine, Arginine | H, K, R |
| Acidic and their amides | Aspartate, Glutamate, Asparagine, Glutamine | D, E, N, Q |

In some embodiments, conservative changes are those that are within one or more of these six classes (for example, substituting one amino acid for a different amino acid in the same cell of Table 1).

In some embodiments, where amino acids are substituted, a series of non-natural amino acids which may be used in place of natural amino acids include, but are not limited to, 3-amino 2-hydroxy pyridine; (2-furyl)alanine; 1-amino-1-cyclohexane carboxylic acid; (2-thienyl)alanine; 2-aminobenzoic acid (2-Abz); 2-pyridylalanine; 1-amino-1-cyclopentanecarboxilic acid; 2-aminobutyric acid (2-Abu); 3-amino-3-phenylpropionic acid; aminocyclopentane carboxylic acid (ACPC); 4-aminomethylbenzoic acid (Amb); aminoisobutiric acid (Aib); p-benzoyl-1-phenylalanine (Bpa); allylglycine; 4-aminomethyl cyclohexane carboxylic acid (Amc); cyclohexyl-alanine (Cha); delta-valine; delta-leucine; cyanobbutylalanine (Cba); indanylglycine (Igl); 3-(1-naphtyl)-alanine; 3-(2-naphthyl)alanine (1-NaI); biphenylalanine (Bip); hydroxyproline (Hyp); isonipecotic acid (Inp); norvaline (Nva); 4-iodophenylalanine (Phe(pI)); 4-nitrophenylalanine; 4-methylphenylalanine; homophenylalanine (hPhe); 4-aminophenylalanine (Phe4NH(Boc); phenyl glycine; alanine(2'-quinolyl); alanine (2' pyridine); tryptophan; tryptophan N-Methyl; 2-azetidine carboxylic acid; pipecolic acid (Pip); propargylglycine; thioproline (Thz); butylglycine (Tle); 3-nitrotyrosine; 3-aminobenzoic acid (3-Abz); 3-amino-3-phenyl propionic acid; (1-indanylglycine); (2-indanylglycine); allyl glycine; 3-nitrotyrosine; 1,2,3,4-tetrahydroisoquinoline-3-carboxylic acid; beta amino acids; gamma amino acids; Asp (tert-butyl)-OH, 3,3-diphenyl-alanine; 3,3,3 dimethylphenyl-alanine; Asp(β ethyl); Glu (β-ethyl), Asp (β-methyl), Asp (β-tert butyl), Glu (β-tert butyl), Leu (O-phosphate), Serine (O-phosphate), Serine (phosphate), leucine phosphate derivatives.

In some embodiments, the substitutions (e.g., from the luminescent protein to a portion of the signaling domain of the indicator compound) can include a substitution of any one or more of amino acids A, C, D, E, F, G, H, I, K, L, M, N, P, Q, R, S, T, V, W, or Y to any one or more of amino acids A, C, D, E, F, G, H, I, K, L, M, N, P, Q, R, S, T, V, W, or Y. In some embodiments, hydrophilic or nonhydrophobic amino acids are replaced by hydrophobic amino acids (including those comprising aromatic groups such as phenyl). In several embodiments, providing additional hydrophobic amino acids has been shown to improve the insensitivity of the proteins to temperature.

In several embodiments, these modifications increase the selectivity of the binding protein. The term "increased selectivity" means that the conformational change of the binding portion, as for instance detectable by a decrease of fluorescence and/or FRET between the two signaling portions of the fusion protein, is significantly reduced for at least one compound other than the desired analyte (e.g., glucose). Using glucose as an example, such other compounds may for example be sugars, i.e. mono-, di- or oligosaccharides, sugar alcohols, other carbohydrates like for instance starch or conjugates between a carbohydrate and an aglycone moiety. In several embodiments, this reduction of the conformational change (measured by, for example, comparing the change of energy emitted by the two detection portions at a concentration of 0.1 mM and 10 mM of the compound in question), is by equal to or at least about: 20%, 50%, 80%, 90%, 99%, 100%, or ranges spanning and/or including the aforementioned values. In several embodiments, the binding portion of a fusion protein of does not show any significant conformational change for at least one compound for which the corresponding wild-type binding protein shows a significant conformational change.

In some embodiments, as disclosed elsewhere herein, the indicator compound (e.g., the fusion protein, split fusion protein, etc.) comprises one or more binding proteins or binding domains, fragments, active portions, or variants of any one of the foregoing. In some embodiments, the fusion protein comprises one or more of a D-galactoside/methylgalactoside ABC transporter periplasmic binding protein (MglB), or a binding domain, fragment, active portion thereof, and/or variant of any of the foregoing. In some embodiments, the fusion protein comprises one or more of a glucose/galactose-binding protein (GGBP) sequence or a binding domain, fragment, active portion thereof, and/or variant of any of the foregoing. In some embodiments, the fusion protein comprises one or more of a concanavalin protein, a binding domain, fragment, an active portion thereof, and/or variant of any of the foregoing.

GGBP belongs to a large family of proteins that have evolved to specifically recognize glucose/galactose molecules. The evolutionary driving force for these proteins was to help the organism migrate towards glucose; an energy source for survival of the organism, by activating chemotaxis. Given the central role of chemotaxis in survival of the organism, this protein has been conserved in many different species. These are families of glucose binding proteins found in many organisms belonging to bacteria, archea and eukaryote taxonomic groups. In several embodiments, a GGBP protein, binding domain, fragment, an active portion thereof, and/or variant of any of the foregoing is used as the analyte binding region of the indicator compound.

Concanavalin is another class of proteins that is primarily found in numerous species of bacteria and plants. Concanavalin A is specifically interesting in the application of the indicator compounds disclosed herein as it binds glucose and changes its protein structure. This change in protein structure can be utilized to design a glucose binding dependent fluorescence change either with a genetically engineered protein-based fluorescence tag or a fluorescence dye covalently attached to the protein that senses the change in environment as Concanavalin A changes its conformation due to glucose binding. This family of glucose binding proteins are found in 4251 distinct species across several taxonomic kingdoms, namely, plants, bacteria, archea, fungi and viruses. This class of proteins can potentially be swapped in place of glucose/galactose binding proteins to function as glucose detectors. In several embodiments, a Concanavalin protein, binding domain, fragment, an active portion thereof, and/or variant of any of the foregoing is used as the binding domain of the indicator compound.

Of particular interest are proteins from organisms (e.g., signaling proteins and/or binding proteins) that have evolved to survive in extreme conditions. Some of these organisms with enhanced robustness survive in high/extreme temperatures and are commonly known as thermophiles/hyperthermophiles such as *Thermus Thermophilus, Sulfolobus solfataricus, Pyrolobus fumari, Thermus aquaticus*, etc. among others. The glucose binding proteins found in these thermophiles/hyperthermophiles have the ability to endure extreme temperatures which increases the stability of the protein structure. This increased protein stability allows developing of a robust sensor with longevity, and signal stability essential for an implantable sensor. In several embodiments, the analyte binding protein, binding domain, fragment, an active portion thereof, and/or variant of any of the foregoing is from a thermophile or hyperthermophile. In several embodiments, having a large repertoire of glucose binding proteins allows for the flexibility to select good glucose binding segments to genetically engineer a chimeric fluorescence glucose sensor by selecting a signaling molecule (fluorescent reporter) from an equally large repertoire. In several embodiments, the indicator compounds disclosed herein have increased insensitivity to pH value and/or temperature. In several embodiments, the proteins from which the indicator compounds are derived have increased insensitivity to pH value and/or temperature. In several embodiments, the indicator compounds disclosed herein have stability. In several embodiments, the proteins from which the indicator compounds are derived have increased stability.

In some embodiments, analyte binding sequences (e.g., GGBP, concavalin, etc.) may provide the binding region of the indicator compound. In some embodiments, the analyte for these binding regions is glucose (e.g., the molecule that binds to the binding region). In some embodiments, the binding protein or binding domain thereof is modified to exclude post-translationally modified or other regions, such as the N-terminal signal peptide.

In some embodiments, the fusion protein comprises one or more of a Mg1B sequence and/or a Glucose Binding Protein Amino Acid sequence as shown in FIGS. 2B (e.g., SEQ ID NO: 2) and 3B (e.g., SEQ ID NO: 15), respectively. In other embodiments, other analyte and/or binding proteins are used (including circularly permuted versions of those proteins) including those disclosed in FIGS. 8A(1)-8A(100) (e.g., SEQ ID NOs: 122-221; concanavalin proteins) and FIGS. 9A(1)-9A(43) (e.g., SEQ ID NOs: 1704-1746; GGBP proteins from archea SEQ ID Nos: 1704-1734, GGBP proteins from fungi SEQ ID Nos: 1735-1743; GGBP proteins from plants SEQ ID Nos: 1744-1746) (as well as variants of any of the foregoing).

In some embodiments, the binding region (e.g., glucose binding region) of the indicator compounds has a sequence that is identical to that of any one of SEQ ID NOs: 2, 15, 122-221, and/or 1704-1746 (as shown in the figures and/or the accompanying sequence listing). In some embodiments, the binding domain has a sequence that is a variant of any one of SEQ ID NOs: 2, 15, 122-221, and/or 1704-1746. In some embodiments, the binding domain has a sequence that is independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identical to that of any one of SEQ ID NOs: 2, 15, 122-221, and/or 1704-1746. In some embodiments, the binding region has a sequence that independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) homology or similarity to that of any one of SEQ ID NOs: 2, 15, 122-221, and/or 1704-1746. In some embodiments, the binding proteins or binding domains, fragments, or portions thereof are truncated or extended (e.g. with a linker) at the N-terminus and/or C-terminus by a number of amino acids, such as 1, 2, 3, 4, 5, 6, 7, 8, 9, or 10 amino acids.

In some embodiments, the binding domain (e.g., sugar binding domain), one or more fragments of the binding domain, and/or a binding unit of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identity, homology, and/or similarity to a contiguous portion of one or more of SEQ ID NO:2 or SEQ ID NO:15.

In some embodiments, a contiguous portion of the binding domain of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identity, homology, and/or similarity to a contiguous portion of one or more of SEQ ID NOs: 2, 15, 122-221, and/or 1704-1746. In some embodiments, a contiguous portion of the binding domain of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identity, homology, or similarity to a contiguous portion of one or more of SEQ ID NOs: 3-13 and/or 16-20. In some embodiments, the contiguous portion of the indicator compound may include the entire binding domain, one or more fragments of the binding domain (e.g., binding fragments), and/or a binding unit of the signaling domain. In some embodiments, the contiguous portion of one or more of SEQ ID NOs: 2, 15, 122-221, and/or 1704-1746 is equal to or at least about: 200, 100, 80, 60, 50, 40, 30, 20, or 10 amino acids in length (or ranges including and/or spanning the aforementioned values).

In several embodiments, the indicator compound may comprise multiple (two, three, four, etc.) contiguous portions that share the aforementioned identity values, homology values, or similarity values to contiguous portions of SEQ ID NOs: 2, 15, 122-221, and/or 1704-1746. To illustrate, the indicator compound may comprise a first contiguous portion 80 amino acids in length and that is between 90% and 100% homologous to a contiguous portion 80 amino acids in length of SEQ ID NO:15. Additionally, that indicator compound could comprise a second, different contiguous portion that is 40 amino acids in length and that is 100% identical to a second, different contiguous portion of SEQ ID NO:15 that is 40 amino acids in length.

As will be appreciated, the indicator compound may comprise single or multiple contiguous portions of both signaling and binding proteins. As an illustration, a split indicator compound having may comprise SEQ ID NO:1 split between Y143 and N144 with SEQ ID NO: 2. This structure would include a 143 amino acid contiguous segment with 100% identity to the first 143 amino acids of SEQ ID NO:1, a 332 amino acid contiguous segment with 100% identity to the 332 amino acids of SEQ ID NO: 2, and a 95 amino acid length contiguous segment with 100% identity to the second 93 amino acids of SEQ ID NO:1.

In some embodiments, the contiguous portion of one or more of SEQ ID NOs: 2, 15, 122-221, and/or 1704-1746 optionally has 1, 2, 3, 4, 5, 6, 7, 8, 9, or 10 amino acid differences relative to the contiguous portion of the indicator compound. In some embodiments, the amino acid differences include insertions, deletions, and/or substitutions. In some embodiments, the substitutions can include a substitution of any one or more of amino acids for other amino acids. In some embodiments, amino acid substitutions are conservative or non-conservative. In some embodiments, conservative changes include those that are within one or more of these six classes shown in Table 1. In some embodiments, where amino acids are substituted, a series of non-natural amino acids (as disclosed elsewhere herein) may be used in place of natural amino acids. In some embodiments, the substitutions can include a substitution of any one or more of amino acids A, C, D, E, F, G, H, I, K, L, M, N, P, Q, R, S, T, V, W, or Y to any one or more of amino acids A, C, D, E, F, G, H, I, K, L, M, N, P, Q, R, S, T, V, W, or Y. In some embodiments, hydrophilic or nonhydrophobic amino acids are replaced by hydrophobic amino acids (including those comprising aromatic groups such as phenyl). In several embodiments, providing additional hydrophobic amino acids has been shown to improve the insensitivity of the proteins to temperature.

In some embodiments, the fusion proteins comprise one or more of the sequences disclosed herein (or variants thereof). In some embodiments, the indicator compounds (e.g., fusion proteins) have a sequence that is identical to that of any one or more of SEQ ID NOs: 3-13 and 16-20 (as shown in FIGS. 2C(1)-2C(11) and 3C(1)-3C(5)). In some embodiments, the indicator compounds have sequences that are independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% identical to that of any one of SEQ ID NOs: 3-13 and 16-20 (or ranges including and/or spanning the aforementioned values). In some embodiments, the indicator compounds have sequences that independently share equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% homology or similarity to that of any one of SEQ ID NOs: 3-13 and 16-20 (or ranges including and/or spanning the aforementioned values).

In some embodiments, a contiguous portion of the indicator compound (e.g., fusion protein) is independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% identical to a contiguous portion of one or more of SEQ ID NOS: 3-13 and 16-20 (or ranges including and/or spanning the aforementioned values). In some embodiments, a contiguous portion of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% homology or similarity to a contiguous portion of one or more of SEQ ID NOS: 3-13 and 16-20 (or ranges including and/or spanning the aforementioned values). In some embodiments, the contiguous portion of the indicator compound is a portion of the compound that is equal to or at least about 200, 150, 100, 80, 60, 50, or 40 amino acids in length (or ranges including and/or spanning the aforementioned values). In some embodiments, the contiguous portion of SEQ ID NOS: 3-13 and 16-20 is a portion of the those proteins that is equal to or at least about: 200, 150, 100, 80, 60, 50, or 40 amino acids in length (or ranges including and/or spanning the aforementioned values). In some embodiments, the contiguous portion of one or more of SEQ ID NOs: 3-13 or SEQ ID NOs: 16-20 optionally has 1, 2, 3, 4, 5, 6, 7, 8, 9, or 10 amino acid differences relative to the contiguous portion of the indicator compound. In some embodiments, the amino acid differences include insertions, deletions, and/or substitutions. In some embodiments, the substitutions can include a substitution of any one or more of amino acids for other amino acids. In some embodiments, amino acid substitutions are conservative or non-conservative. In some embodiments, conservative changes include those that are within one or more of these six classes shown in Table 1. In some embodiments, where amino acids are substituted, a series of non-natural amino acids (as disclosed elsewhere herein) may be used in place of natural amino acids. In some embodiments, the substitutions can include a substitution of any one or more of amino acids A, C, D, E, F, G, H, I, K, L, M, N, P, Q, R, S, T, V, W, or Y to any one or more of amino acids A, C, D, E, F, G, H, I, K, L, M, N, P, Q, R, S, T, V, W, or Y.

In some embodiments, as disclosed elsewhere herein, the binding region can be for an analyte other than a sugar. In some embodiments, the binding region (e.g., glucose binding region) of the indicator compounds has a sequence that is identical to that of any one of SEQ ID NOs: 824-1703 (as shown the accompanying sequence listing). In some embodiments, the binding domain has a sequence that is a variant of any one of SEQ ID NOs: 824-1703. In some embodiments, the binding domain has a sequence that is independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identical to that of any one of SEQ ID NOs: 824-1703. In some embodiments, the binding region has a sequence that independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) homology or similarity to that of any one of SEQ ID NOs: 824-1703. In some embodiments, the binding proteins or binding domains, fragments, or portions thereof are truncated or extended (e.g. with a linker) at the N-terminus and/or C-terminus by a number of amino acids, such as 1, 2, 3, 4, 5, 6, 7, 8, 9, or 10 amino acids.

In some embodiments, a contiguous portion of the binding domain of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identity, homology, and/or similarity to a contiguous portion of one or more of SEQ ID NOs: 824-1703. In some embodiments, the contiguous portion of the indicator compound may include the entire binding domain, one or more fragments of the binding domain (e.g., binding fragments), and/or a binding unit of the signaling domain. In some embodiments, the contiguous portion of one or more of SEQ ID NOs: 824-1703 is equal to or at least about: 200, 100, 80, 60, 50, 40, 30, 20, or 10 amino acids in length (or ranges including and/or spanning the aforementioned values).

In some embodiments, a strand of contiguous amino acids in the indicator compound (e.g., having 200, 150, 100, 50, 40, 30, 25, 20, or 10, contiguous residues, or ranges including and/or spanning the aforementioned values) independently shares an identity or homology of equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) with a coinciding contiguous portion of the any one of SEQ ID NOs: 1-1746.

In some embodiments, as disclosed elsewhere herein, the binding protein (e.g., glucose binding protein) and/or binding portion of the binding protein splits (through insertion) the signaling portion and/or one or more luminescing fragments of a luminescent protein. In other embodiments, as disclosed elsewhere herein, the signaling portion and/or one or more luminescing fragments of a luminescent protein splits (through insertion) the binding protein (e.g., sugar binding protein) and/or binding portion of the binding protein. Where that insertion occurs along the signaling portion (and/or one or more luminescing fragments of a luminescent protein chain) or along the binding protein (and/or binding portion of the binding protein) the position of the insertion can vary from fusion protein to fusion protein and can occur at any location so long as a conformational change occurs that allows detection of an analyte.

In some embodiments, the insertion may occur within the first 10% of the protein that is split, the second 10% of the protein that is split, the third 10% of the protein that is split, the fourth 10% of the protein that is split, the fifth 10% of the protein that is split, the sixth 10% of the protein that is split, the seventh 10% of the protein that is split, the eighth 10% of the protein that is split, the ninth 10% of the protein that is split, or the tenth 10% of the protein that is split. For instance, when the insertion is in the second 10% of a 100 amino acid length protein that is split, the insertion can occur between any one of amino acids 11 to 20. The insertion can be in a loop, a helix (e.g., an α-helix or π-helix), or in a β-strand of a β-sheet of a protein or protein fragment. The inserted portion may be inserted into the split domain at a position within the first quarter (e.g., ¼ or between the 0% and 25%) of the amino acids of the split domain, within the second quarter (e.g., between ¼ and 2/4 or between the 25% and 50%) of the amino acids of the split domain, within the third quarter (e.g., between 2/4 and ¾ or between the first 50% and 75%) of the amino acids of the split domain, or within the fourth quarter (e.g., between ¾ and 4/4 or between the first 75% and 100%) of the amino acids of the split domain.

In some embodiments, the fluorescent molecule is citrine, or a fluorescent fragment or portion thereof. In some embodiments, citrine is split at a position within the following amino acid sequence NRIELKGIDFKEDGNILGHKLEYNYNSHNV. In some embodiments, citrine is split after Y144 (or Y143 of SEQ ID NO: 1, which is lacking the first methionine). In some embodiments, the analyte binding protein is a glucose/galactose-binding protein (GGBP), or an analyte binding fragment or portion thereof. In some embodiments, where GGBP is of SEQ ID NO: 2, the GGBP is split at a position within the following amino acid sequence DGTNWKIDNKVVRVPYVGVDKDNLAEFSKK. In some embodiments, GGBP is split after P317 of SEQ ID NO: 2 (or P295 of SEQ ID NO: 15, which is lacking the N-terminal signal peptide sequence). Where variants of citrine or GGBP are used, the region that is split may have sequences that are independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% identical to those of NRIELKGIDFKEDGNILGHKLEYNYNSHNV or DGTNWKIDNKVVRVPYVGVDKDN-LAEFSKK (or ranges including and/or spanning the aforementioned values). Where variants of citrine or GGBP are used, the region that is split may have sequences that independently share at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% homology or similarity to those of NRIELKGIDFKEDGNILGHKLEYNYNSHNV or DGTNWKIDNKVVRVPYVGVDKDN-LAEFSKK (or ranges including and/or spanning the aforementioned values).

In some embodiments, the indicator compound comprises one or more of the following proteins (as identified by their UniProt number), an indicating portion thereof, or a binding portion thereof: P02916, P68183, P0AEX7, P0A9K7, P33650, P0AFF4, P0A9S7, P0A830, P31547, P14176, P0ABV2, P46133, P0ABU7, P23847, P0AFT2, P15993, P0AFF2, P64604, P0AD99, P43671, P21345, P22729, P10384, P0ABB8, P64602, P64606, P0AE95, P30859, P06611, P0A6E6, P17315, P27254, P0AEA2, P75712, P0AAF3, P0AAE5, P31224, P52697, P0AAF6, P0A940, P0ADP5, P0AB93, P76345, P32705, P37019, P32720, P32721, P45955, P0AE16, P0ABC9, P0AB98, P30860, P0AE30, P0ABE5, P76175, P39180, P0AE98, P0AE06, P0AE56, P31553, P39265, P36548, P0ABA6, P0ABD3, P46481, P77610, P0ABB4, P75733, P24177, P69856, P63020, P07014, P0AG96, P0AAB2, Q47706, Q46909, P45769, P21829, P0AAA7, P77328, Q46819, Q46892, P0AGM9, P0AFQ2, P76344, P75683, P0ABD1, P77716, P39832, P39830, P0AA49, P0AFR7, P67444, Q46905, P0AA73, P39325, P0A9T8, P0AG90, P77223, P25396, P77529, P77504, P27837, P0AG80, P09835, P77726, Q46908, P0AGA6, P77315, P0AFP9, P76655, P43531, P45394, P37662, P37660, P43667, P0A850, P0AGG4, P39263, P37197, P75693, P46136, P45767, P10907, P75750, P0CE44, P75783, P52102, P0AD03, P39414, P76269, P0ADZ7, P37674, P0AA63, P77269, Q46833, P36879, P45537, P60869, P33011, P63340, P31437, P77519, P63389, P32135, P0AEB5, P69820, P45766, P37642, P39172, P0AA70, P76335, P32137, P76115, P56256, P77536, P42915, P31435, P52005, P76272, P76042, P45768, P31436, P39301, P77400, P0AGM0, P37388, P07604, Q46863, P76630, P37387, P0AA57, P23173, P0AFV2, P0A927, P37643, P0A9U3, P37621, P0AGC0, P75757, P37676, P0AFN6, P37675, P75763, P0AGH1, Q46834, P10906, P0ABT8, P39328, P39321, P31135, P31549, P0AFY6, P31679, P0AAH4, P77714, P33941, P46121, P36881, P20966, P69816, P33913, P76628, P0AEY8, P24241, P02930, P0A766, P77795, P45562, P39901, P0A9X1, P58035, C1P5Z7, P10905, P52052, P0AA25, P39365, P33361, P33362, P0A710, P39277, P02929, P65367, P60778, P76356, P37188, P75835, P0AAL9, P0A853, P43672, Q46871, P0AFZ7, P0AG93, P0AGA2, P0AGI4, P52636, P37774, P0A930, P31448, P76350, P0AGH3, P0A855, P31122, P76224, P30143, P00550, P02925, P0AGF4, P75870, P25714, P0AFS7, P33915, P0DP21, P33359, P45420, P0AAD4, P37619, P76186, P33360, P0AF43, P77481, P0AA60, P37327, P0AAH8, P69822, Q46821, P77156, P75788, P75810, P25747, P0AFR9, P76173, P76909, P0AAT4, P69210, P45762, P04983, P00448, P76201, P39352, P39357, P77179, P77611, P0AGH5, P77378, P0AC98, P21503, P52647, P32154, P77272, P33024, P0ABW3, P77409, P0AFU2, P0AFU0, P07001, P69826, P77285, P77228, P39282, P37772, P38055, P33916, Q47539, P77499, P24207, P64559, P0AAI1, P31675, P10408, P76352, P0AG78, P0AAD8, Q47622, P42910, P77439, P76182, P76037, P37177, P0AGI8, P08722, P77338, P33594, P0AC41, P0AAD6, P0AFS5, P76027, P0A8T1, P76470, P77468, Q47689, P76399, P09348, P23482, P0ADC6, P31134, P76045, P0AC96, P0AG38, P76197, P0AGM7, P39386, P77682, P31826, P77389, P33341, P76230, P0ADD5, P76108, P0A754, P19934, P0AG99, P75851, P77549, P75853, P37440, P0AGE4, P76417, P77196, P76198, P0AD30, P38101, P0A910, P37597, P0ADD2, P11350, P69434, P43676, P32136, P32703, P39836, P0AG86, P33026, P31126, P0AAJ1, P67729, P0A8H3, P0AAK7, P37746, P76425, P69824, P13445, P56579, P69811, P31548, P76278, P64423, P42911, P69831, P0ABU9, P0AF06, P69428, P33021, P36672, P0ADE4, P0AGH8, P09836, P0A9U1, P42590, Q46907, Q6BEX0, P0AEF8, P77031, P0AFJ7, P0AA67, P0ABV6, P37617, P60872, P77509, Q46832, P06996, P42909, P77579, P76773, P27125, P27844, P09323, P69783, P0AFL1, P0AFL9, P0AFJ5, Q46877, P0COL7, P31133, P0ADL1, P32670, P08839, P13738, P19642, P0ABL5, P0AFA9, P33602, P32676, Q47538, P0AAE2, P0AFA2, P29745, P19319, P21420, P32672, P69789, P23849, P41442, P08400, P0AA04, P42905, P36929, P33226, P75892, P69425, P0AG82, P09378, P56580, P69786, P69423, P39363, P0AFF0, P31550, P75831, P02932, P0A7N1, Q47537, P0A843, P0AFK9, P38683, P0AAM1, P17583, P37340, P0A9V1, P25737, P0ACK2, P31069, P0AFC3, P54745, P36646, P16685, P16256, P16677, P39285, P16678, P77589, P69212, P33231, P75742, P39835, P0A6X7, P41443, P45763, P16682, P0DP70, P60061, P46846, P31474, P39398, P0ADV, A5A616, P37028, P33129, P0AAG5, P0ACJ0, P22731, P0AFH6, P15030, P16869, P68688, P64638, P0AD96, P25527, P77672, P37595, P23200, P75824, P0ABN5, P77308, P75857, P0AFS1, P06972, P0AEL6, P25744, P45756, P63386, P45757, P36937, P0AE63, P0AEE5, P13669, P75958, P39276, P15029, P0AEL3, P37349, P37902, P0ABL8, P0ABA4, P0ABM, P0AC59, P0AER5, P0AC62, P0A712, P0ADV7, P07654, P69797, P69805, P0AG34, P05706, P0A915, P69791, P17334, P0AFE8, P0AFA7, P0AC65, P69828, P33607, P69801, P0AAZ4, P69795, P0AAG0, P32714, P16432, P75826, P0AGI1, P32155, P04982, P31452, P0A742, P02931, P69808, P0COS1, P11349, P37758, P60752, P0A9F1, P0A996, P42628, P37329, P0A759, P33590, P0AFK4, P0AFH2, P0AFK6, P77423, P63183, P16429, P42904, P19318, P0AB10, P07117, P77348, P0AFE4, P37624, P0AAK1, P03817, P23930, P0A9I5, P16684, P0ABK9, P77737, P09833, P0ABA0, P52599, P24169, P76242, P0A9G8, P23843, P0AEG1, P77257, P14175, P69874, P75901, P39344, P03960, P75830, P08189, P0A9A9, P52094, P36645, P0AFM2, P41036, P33591, P76264, P08190, P31462, P76398, P31554, Q47142, P75797, P0A6M2, P0ACK5, P75798, P52074, P45758, P45522, P38038, P16701, P0AF52, P0AAI3, P77279, P0AEX3, P68699, P03959, P76249, P0AE74, P75681, P77307, P32715, P75957, P69367, P29018, P38135, P0AC94, P03961, P37180, P0A9R7, P76552, P69451, P0ADC3, P0AF98, P16700, P06149, P0AEQ6, P52612, P76014, P0AEP, P76343, P09152, P0A769, P0A6T1, P10903, P0AF16, P33593, P0AAL3, P33937, P0AF0, P0ABL3, P0AAD2, P0AAH0, P77747, P45761, P75796, P68187, P02921, P76081, P76078, P39396, P23895, P07109, Q46916, P60664, P0DP69, P31060, P33599, P36837, P23485, P23878, P76555, P0AB24, P23481, P41441, P31442, P63235, P37339, P0AFI9, P0AFK2, P0AEU0, P24232, P37637, P45759, P0AEX9, P0ABB0, P0ABJ1, P61949, P0ABL1, P33934, P0AC26, P0AFC7, P37002, P36678, P04816, P76007, P0ADC1, P08200, P00634, P0AF32, P40191, P0AA47, P0AEU3, P76397, P0AAF1, P52600, P0ABJ9, P02920, P64550, P0ABK2, P0ABN9, P23876, P26266, P76128, P0A8V6, P0AC47, P76299, P0AAE0, P45539, P77211, P0ABT5, P0AC23, P45428, P60566, P77622, P76298, P0A6J3, P77463, P77268, P0AE26, P69681, P27303, P0A998, P0ABP3, P09394, P0A9R4, P69490, P26459, P0AC02, P0ABM5, P33931, P56100, P0AAE8, Q46839, P24180, P0A901, P75925, P0AAW9, P09551, P0AA82, Q47377, P36655, P39196, P0A756, P45760, P02943, P03819, P77304, P69054, P0ABW0, P37195, P0AAJ3, P26648, P07822, P0ABJ3, P0AEQ3, P06971, P00393, P0AA76, P68646, P22255, P0AEB0, P36554, P34749, P03841, P31125, P08194, P0ABG4, P37636, P0AFR2, P54746, P28635, P0AAG8, P61320, P0ADV9, P75799, P76506, P76474, P06609, P31466, P31574, P31068, P15028, P69380, P77265, P16676, P30750, P25960, P0AAK4, P06989, P39163, P24181, P38054, P32716, P61316, P08555, P0ABI8, P68644, P0AF61, P23484, P0AA78, P0A9A2, P29131, P0AEL0, P37313, P0AEJ0, P23877, P77733, P0AC05, P0AAJ5, P52613, P0C8J8, P0AEK7, P0AER0, P69937, P18777, P16703, P23910, P0A8S1, P76460, P36930, P31440, P06129, P26218, P76015, P0A9E0, P31545, P10346, P77239, P75780, P07821, P00363, P0ABC0, P0AEN1, P0ABY4, P11551, P27296, P11667, P15078, P10378, P0AE12, Q46817, P15031, P0C8J6, P05825, P63883, P06610, Q59385, P31801, P30130, P0AAG3, P28246, P0ABJ6, P46482, P60844, P0AEM9, P0AE34, P0A932, P0ABI4, P37009, P24077, P52067, P26458, P77802, P0AA80, P23886, P13039, P0AER8, P0AE78, P0AE24, P13036, P02924, P69922, P18776, P0AER3, P0AC44, luminescing or fluorescing fragments of any of the foregoing, portions of any of the foregoing, or variants of any of the foregoing. In some embodiments, the indicator compounds (e.g., fusion proteins) comprise one or more of proteins having a sequence that is independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% identical to that of any one of the proteins as identified by their UniProt number herein (or ranges including and/or spanning the aforementioned values). In some embodiments, the indicator compounds (e.g., fusion proteins) comprise one or more of proteins that independently share equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% homology or similarity to that of any one of the proteins as identified by their UniProt number herein (or ranges including and/or spanning the aforementioned values). In some embodiments, a contiguous portion of the indicator compound (e.g., fusion protein) is independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% identical to a contiguous portion of to any one of the proteins as identified by their UniProt number herein (or ranges including and/or spanning the aforementioned values). In some embodiments, a contiguous portion of the indicator compound independently shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% homology or similarity to a contiguous portion of to any one of the proteins as identified by their UniProt number herein (or ranges including and/or spanning the aforementioned values). In some embodiments, the contiguous portion of the indicator compound is a portion of the compound that is equal to or at least about: 200, 150, 100, 80, 60, 50, or 40 amino acids in length (or ranges including and/or spanning the aforementioned values). In some embodiments, the contiguous portion of a protein as identified by its UniProt number herein (or ranges including and/or spanning the aforementioned values) is a portion of the those proteins that is equal to or at least about: 200, 150, 100, 80, 60, 50, or 40 amino acids in length (or ranges including and/or spanning the aforementioned values). In some embodiments, the contiguous portion of a protein as identified by its UniProt number herein optionally has 1, 2, 3, 4, 5, 6, 7, 8, 9, or 10 amino acid differences relative to the contiguous portion of the indicator compound. In some embodiments, the amino acid differences include insertions, deletions, and/or substitutions. In some embodiments, the substitutions can include a substitution of any one or more of amino acids for other amino acids. In some embodiments, amino acid substitutions are conservative or non-conservative. In some embodiments, conservative changes include those that are within one or more of these six classes shown in Table 1. In some embodiments, where amino acids are substituted, a series of non-natural amino acids (as disclosed elsewhere herein) may be used in place of natural amino acids. In some embodiments, the substitutions can include a substitution of any one or more of amino acids A, C, D, E, F, G, H, I, K, L, M, N, P, Q, R, S, T, V, W, or Y to any one or more of amino acids A, C, D, E, F, G, H, I, K, L, M, N, P, Q, R, S, T, V, W, or Y. In some embodiments, a strand of contiguous amino acids in the indicator compound (e.g., having 200, 150, 100, 50, 40, 30, 25, 20, or 10, contiguous residues, or ranges including and/or spanning the aforementioned values) independently shares an identity or homology of equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) with a coinciding contiguous portion of a protein as identified by its UniProt number herein.

As an alternative to fully genetically engineered glucose binding fluorescent proteins, fluorescent dyes can be covalently attached to binding domains of the indicator compound (e.g., proteins, such as, GGBP or Concanavalin A). These dyes may be bonded as a subsequent step after purifying binding proteins from their respective protein expression systems. In some embodiments, this would involve engineering a covalent binding site such as cysteine, lysine, arginine, glutamic acid, aspartic acid residues on a specific site on the glucose binding domain in such a manner that the conformational changes in the protein due to analyte (e.g., glucose) binding are picked up as fluorescence changes on that covalently attached dye. In some embodiments, dyes are specifically picked to sense such environment changes with conformational changes in the protein. In general, these dyes change their fluorescent propensities depending on the polarity of their environments.

Exemplary dyes include but are not limited to indole, Cascade Yellow, Prodan, Dansyl, Dapoxyl, (2-(4-nitro-2,1, 3-benzoxadiazol-7-yl)) (NBD), 1-(3-carboxybenzyl)-4-(5-(4-methoxyphenyl)oxazol-2-yl)pyridiniumbromide (PyMPO), Pyrene and diethylaminocumarin are such chemical groups that exhibit this property. Based on these chemical moieties, there are a large range of fluorescent dyes that has been developed commercially to site specifically attach to the previously mentioned binding sites on protein, namely, thiol-reactive for Cysteine, amine-reactive for Lysine and Arginine residues, carboxylic acid-reactive for aspartic acid and glutamic acid residues. These reactions can include coupling reactions with, for example, carbodiimides, such as EDC.

Apart from simply detecting change in fluorescence, another phenomenon called FRET (Förster resonance energy transfer) can be alternately used to detect the conformation changes in binding proteins (e.g., glucose binding proteins such as GGBP or Concanavalin A). FRET is a property in which the energy of the excited electron of one fluorescent dye, called the donor, is passed on to a nearby acceptor fluorescent dye, which has an excitation spectrum which overlaps with the emission spectrum of the donor dye resulting in a reduced fluorescence of the donor, while increased fluorescence of the acceptor. This can be used to detect changes in conformation of the protein by carefully engineering the fluorescent sites on the analyte (e.g., glucose) binding proteins. FRET is versatile enough to accommodate the use of either fluorescent dyes or fluorescent proteins (GFP). Commercially there are a large repertoire of FRET pairs for both fluorescent dyes, including but not limited to Cy3-Cy5, Fluorescein-Tetramethylrhodamine, IAEDANS-Fluorescein, EDANS-Dabcyl, etc. and fluorescent proteins (CFP-YFP, GFP-RFP). It is noted here that each pairs have an unique optimal distance between the acceptor and donor fluorescence. The modular design of the sites of attachment of acceptor and donor allows developing such FRET based glucose sensors.

General characteristics of stable protein based analyte (e.g., glucose) sensors include one or more of the following (or other properties): Presence of extra hydrogen bonding interactions, rich in electrostatics based salt-bridges, rich in extra disulfide bridges within the core of the protein, higher levels of hydrophobic amino acids that stabilize the protein core. The stability of analyte (e.g., glucose) binding proteins will translate to greater stability of the constructed analyte (e.g., glucose) sensors. The above general characteristics of a protein decreases the unfolding rate of any soluble protein. By scanning the variants of GGBP protein in other organisms, especially the species that are classified as extremophiles that have evolved in extreme temperatures, pH conditions, high salt concentrations, high pressure, ionizing radiation etc. will help in choosing the optimal glucose sensor developing a sensor.

As disclosed herein, this application of glucose binding proteins to build glucose sensors can be extended to other analytes. There are the large group proteins that bind various analytes (including those provided in the UniProt listing elsewhere herein). These glucose binding proteins can be swapped out for other analyte binding proteins to extend this application to detecting other analytes. In some embodiments, the indicator compounds can be used for in vivo, ex vivo, and/or in vitro analyte measurements. In some embodiments, the analyte may comprise any molecule of interest (e.g., sugars, a metabolite such as NADPH, heavy metals, $Ca^{2+}$, sodium, potassium, chloride, iron, copper, zinc, magnesium, phosphorus, urea, creatinine, phosphate, $O_2$, $CO_2$, bicarbonate, cholesterol, HDL, LDL, triglyceride, C-reactive protein, TSH, PTH, thyroxine, triiodothyronine, albumin, globulin, immunoglobulin, bilirubin, AFP, HCG, carcinoembryonic antigen, PSA, PAP, calcitonin, testosterone, dihydrotestosterone, progesterone, FSH, LH, estradiol, cortisol, growth hormone, aldosterone, vitamin A, vitamin B, vitamin C, vitamin D, vitamin E, lead, ethanol, LDH, or amylase, or any combination thereof), which may be used to determine a feature of the environment in which the indicator compound is located. For example, in some embodiments, the analyte is a proton (e.g., $H^+$) and the feature of the environment that is measured is the pH. In some embodiments, as disclosed elsewhere herein, the analyte is glucose. Thus, the indicator can be used to measure blood glucose in, for example, a diabetic, pre-diabetic, or non-diabetic patient. In several embodiments, the analyte is ligand that binds to an *E. coli* transporter protein, such as those of SEQ ID NOs: 824-1703.

Further, based on general protein architecture of periplasmic binding proteins, one can rationally design or artificially direct-evolution such that these proteins can develop binding capabilities to other analytes. Peptides or proteins of the present embodiments can be produced and obtained by various methods. For example, the peptide may be produced by genetic engineering, based on the nucleotide sequence coding for the peptide of the present embodiments, or chemically synthesized by means of peptide solid-phase synthesis and the like, or produced and obtained in their combination. One skilled in the art of solid-phase peptide synthesis can readily incorporate natural or non-natural amino acids in the (D) as well as (L), or the (R) as well as (S), stereochemical configuration. The peptides of the present embodiments may be linear or cyclic, and may include (D) as well as (L) amino acids. Peptides of the present embodiments may also contain one or more rare amino acids (such as 4 hydroxyproline or hydroxylysine), organic acids or amides and/or derivatives of common amino acids, such as amino acids having the C terminal carboxylate esterified (e.g., benzyl, methyl or ethyl ester) or amidated and/or having modifications of the N terminal amino group (e.g., acetylation or alkoxycarbonylamino), with or without any of a wide variety of side chain modifications and/or substitutions (e.g., methylation, benzylation, t butylation, tosylation, alkoxycarbonylamino, and the like). Residues other than common amino acids that may be present include, but are not limited to, penicillamine, tetramethylene cysteine, pentamethylene cysteine, mercaptopropionic acid, pentamethylene-mercaptopropionic acid, 2 mercaptobenzene, 2 mercaptoaniline, 2 mercaptoproline, ornithine, diaminobutyric acid, aminoadipic acid, m aminomethylbenzoic acid, and diaminopropionic acid. Peptides of the present embodiments can be produced and obtained by various methods known to those skilled in the art. For example, the peptide may be produced by genetic engineering, based on the nucleotide sequence coding for the peptide of the present embodiments, or chemically synthesized by means of peptide solid-phase synthesis and the like, or produced and obtained in their combination.

Some embodiments pertain to the nucleic acid sequences that translate to one or more proteins having the sequence of SEQ ID Nos: 1-20 or 33-1746 or to fusion proteins (e.g., split indicator compounds) comprising multiple proteins of SEQ ID Nos: 1-20 or 33-1746. It is envisioned that multiple nucleic acids sequences can be translated to the proteins disclosed herein. In some embodiments, the nucleic acid sequences differ by codons that encode for the same amino acid. In some embodiments, the nucleic acid sequences are codon optimized for a certain organism, such as a human, mouse, rat, rabbit, dog, cat, horse, goat, pig, chicken, fungus, yeast, bacteria, or protozoan.

As disclosed elsewhere herein, certain embodiments pertain to indicator compounds with enhanced stability. Several GGBP proteins are sensitive to pH changes. In view of these findings, GGBP proteins from were generated and screened for novel properties, i.e. a higher selectivity for glucose and/or an increased insensitivity to pH changes. In some embodiments, GGBP fusion proteins in which histidines were modified so that their side chain cannot be protonated are considerably more insensitive to pH. Truncations also may improve stability to pH.

In some embodiments, the fusion protein further comprises one or more linker peptides connecting the first and/or the second signaling portions to the binding portion (or the first and/or the second binding portions to the signaling portion, as the case may be). Such linker peptides may in principle have any length and amino acid sequence which ensures that they do not interfere negatively with the analyte detection function of the fusion protein. In several embodiments, the linker includes equal to or greater than about: 1 amino acid, 3 amino acids, 5 amino acids, 10 amino acids, 15 amino acids, 25 amino acids, 35 amino acids, 50 amino acids, or ranges including and/or spanning the aforementioned values. In several embodiments, any amino acid can be used. In several embodiments, the linker is mainly or only composed of hydrophilic amino acid residues, such as glycine, alanine, threonine and/or serine residues.

Some embodiments also relate to nucleotide sequences encoding fusion proteins and/or indicator compounds as well as methods of delivering those sequences to organisms such that those indicator compounds are expressed. In addition, some embodiments relate to methods for detecting an analyte in a sample or in a cell using said fusion protein, and optionally, a control sensor allowing a calibration of analyte detection made by said fusion protein. In some embodiments, the control sensor and nucleic acid molecules encoding it are disclosed, as well as to diagnostic compositions, kits, and uses of the fusion protein and the control sensor for in vitro or in vivo analyte detection and for preparing a diagnostic composition.

In some embodiments, the nucleotides encoding the indicator compounds have a sequence that is identical to that of any one of SEQ ID NOs: 21-33 (as shown in FIGS. 4A(1)-5A(5)). In some embodiments, the indicator compounds have sequences that are independently equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% identical to that of any one of SEQ ID NOs: 21-33 (or ranges including and/or spanning the aforementioned values). Some embodiments pertain to any nucleic acid that can hybridize a portion of these sequences under moderate or highly stringent conditions.

In some embodiments, a contiguous portion of the DNA encoding the indicator compound is at least equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) identical to a contiguous portion of one or more of SEQ ID NOS: 21-33. In some embodiments, a contiguous portion of the DNA encoding the indicator compound shares equal to or at least about: 60%, 70%, 80%, 85%, 86%, 87%, 88%, 89%, 90%, 91%, 92%, 93%, 94%, 95%, 96%, 97%, 98%, 99%, 99.9%, 99.99%, or 100% (or ranges including and/or spanning the aforementioned values) homology or similarity to a contiguous portion of one or more of SEQ ID NOS: 21-33. In some embodiments, the contiguous portion of the DNA encoding the indicator compound is equal to or at least about 200, 150, 100, 80, 60, 50, or 40 nucleotides in length (or ranges including and/or spanning the aforementioned values). In some embodiments, the contiguous portion of one or more of SEQ ID NOS: 21-33 is a portion of the those DNAs that is equal to or at least about 200, 150, 100, 80, 60, 50, or 40 nucleotides in length (or ranges including and/or spanning the aforementioned values).

Some embodiments relate to expression cassettes comprising nucleic acid molecules as disclosed elsewhere herein (e.g., SEQ ID NOS: 21-33, etc.) and/or nucleic acids transcribing the proteins disclosed herein (e.g., SEQ ID NOs: 1-20 and 34-1746). In some embodiments, the nucleic acid molecules are operably linked to control sequences allowing expression in prokaryotic or eukaryotic cells. Suitable expression control sequences include promoters that are applicable in the target host organism. Such promoters are well known to the person skilled in the art for diverse hosts from prokaryotic and eukaryotic organisms and are described in the literature. For example, such promoters can be isolated from naturally occurring genes or can be synthetic or chimeric promoters. Likewise, the promoter can already be present in the target genome and will be linked to the nucleic acid molecule by a suitable technique known in the art, such as for example homologous recombination.

In some embodiments, the vectors are suitable for the transformation of fungal cells, plant cells, cells of microorganisms (i.e. bacteria, protists, yeasts, algae etc.) or animal cells, in particular mammalian cells. In some embodiments, such vectors are suitable for the transformation of human cells. In addition to the nucleic acid molecule or expression cassette, the vector may contain further genes such as marker genes which allow for the selection of said vector in a suitable host cell and under suitable conditions. Generally, the vector also contains one or more origins of replication. Advantageously, the nucleic acid molecules contained in the vectors may be operably linked to expression control sequences allowing expression, i.e. ensuring transcription and synthesis of a translatable RNA, in prokaryotic or eukaryotic cells.

In one aspect, the expression of the nucleic acid molecules in prokaryotic or eukaryotic cells is interesting because it permits a more precise characterization of the function of the fusion protein encoded by these molecules. In addition, it is possible to insert different additional mutations into the nucleic acid molecules by methods usual in molecular biology (see for instance Sambrook and Russell (2001), Molecular Cloning: A Laboratory Manual, CSH Press), leading to the synthesis of proteins possibly having modified properties, e.g. as concerns binding affinity or energy emission (e.g. RET) efficiency. In this regard, it is possible to mutate the nucleic acid molecules present in the vector by inserting or deleting coding sequences or to introduce amino acid substitutions by replacing the corresponding codon triplets.

For genetic engineering, e.g. in prokaryotic cells, the nucleic acid molecules or parts of these molecules can be introduced into plasmids which permit mutagenesis or sequence modification by recombination of DNA sequences. Standard methods (see Sambrook and Russell (2001), Molecular Cloning: A Laboratory Manual, CSH Press) allow base exchanges to be performed or natural or synthetic sequences to be added. DNA fragments can be connected to each other by applying adapters and linkers to the fragments. Moreover, engineering measures which provide suitable restriction sites or remove surplus DNA or restriction sites can be used. In those cases, in which insertions, deletions or substitutions are possible, in vitro mutagenesis, "primer repair", restriction or ligation can be used. In general, sequence analysis, restriction analysis and other methods of biochemistry and molecular biology are carried out as analysis methods.

The term "identity" refers to a relationship between the sequences of two or more polypeptide molecules or two or more nucleic acid molecules, as determined by aligning and comparing the sequences. "Percent identity" means the percent of identical residues between the amino acids or nucleotides in the compared molecules and is calculated based on the size of the smallest of the molecules being compared. For these calculations, gaps in alignments (if any) are preferably addressed by a particular mathematical model or computer program (i.e., an "algorithm"). Methods that can be used to calculate the identity of the aligned nucleic acids or polypeptides include those described in Computational Molecular Biology, (Lesk, A. M., ed.), 1988, New York: Oxford University Press; Biocomputing Informatics and Genome Projects, (Smith, D. W., ed.), 1993, New York: Academic Press; Computer Analysis of Sequence Data, Part I, (Griffin, A. M., and Griffin, H. G., eds.), 1994, New Jersey: Humana Press; von Heinje, G., 1987, Sequence Analysis in Molecular Biology, New York: Academic Press; Sequence Analysis Primer, (Gribskov, M. and Devereux, J., eds.), 1991, New York: M. Stockton Press; and Carillo et al., 1988, SIAM J. Applied Math. 48:1073.

In calculating percent identity, the sequences being compared are typically aligned in a way that gives the largest match between the sequences. One example of a computer program that can be used to determine percent identity is the GCG program package, which includes GAP (Devereux et al., 1984, Nucl. Acid Res. 12:387; Genetics Computer Group, University of Wisconsin, Madison, Wis.). The computer algorithm GAP is used to align the two polypeptides or polynucleotides for which the percent sequence identity is to be determined. The sequences are aligned for optimal matching of their respective amino acid or nucleotide (the "matched span", as determined by the algorithm). A gap opening penalty (which is calculated as 3.times.the average diagonal, wherein the "average diagonal" is the average of the diagonal of the comparison matrix being used; the "diagonal" is the score or number assigned to each perfect amino acid match by the particular comparison matrix) and a gap extension penalty (which is usually $\frac{1}{10}$ times the gap opening penalty), as well as a comparison matrix such as PAM 250 or BLOSUM 62 are used in conjunction with the algorithm. In certain embodiments, a standard comparison matrix (see, Dayhoff et al., 1978, Atlas of Protein Sequence and Structure 5:345-352 for the PAM 250 comparison matrix; Henikoff et al., 1992, Proc. Natl. Acad. Sci. U.S.A. 89:10915-10919 for the BLOSUM 62 comparison matrix) is also used by the algorithm.

Examples of parameters that can be employed in determining percent identity for polypeptides or nucleotide sequences using the GAP program are the following: Algorithm: Needleman et al., 1970, J. Mol. Biol. 48:443-453 Comparison matrix: BLOSUM 62 from Henikoff et al., 1992, supra Gap Penalty: 12 (but with no penalty for end gaps) Gap Length Penalty: 4 Threshold of Similarity: 0.

Certain alignment schemes for aligning two amino acid sequences may result in matching of only a short region of the two sequences, and this small aligned region may have very high sequence identity even though there is no significant relationship between the two full-length sequences. Accordingly; the selected alignment method (GAP program) can be adjusted if so desired to result in an alignment that spans at least 50 or other number of contiguous amino acids of the target polypeptide.

As used herein and as described elsewhere herein, the twenty conventional (e.g., naturally occurring) amino acids and their abbreviations follow conventional usage. See Immunology—A Synthesis (2nd Edition, E. S. Golub and D. R. Gren, Eds., Sinauer Associates, Sunderland, Mass. (1991)), which is incorporated herein by reference for any purpose. Stereoisomers (e.g., D-amino acids) of the twenty conventional amino acids, unnatural amino acids such as .alpha.-,.alpha.-disubstituted amino acids, N-alkyl amino acids, lactic acid, and other unconventional amino acids can also be suitable components for polypeptides of the present invention. Examples of unconventional amino acids include: 4-hydroxyproline, .gamma.-carboxyglutamate, .epsilon.-N,N,N-trimethyllysine, .epsilon.-N-acetyllysine, O-phosphoserine, N-acetylserine, N-formylmethionine, 3-methylhistidine, 5-hydroxylysine, .sigma.-N-methylarginine, and other similar amino acids and imino acids (e.g., 4-hydroxyproline). In the polypeptide notation used herein, the left-hand direction is the amino terminal direction and the right-hand direction is the carboxy-terminal direction, in accordance with standard usage and convention.

Similarly, unless specified otherwise, the left-hand end of single-stranded polynucleotide sequences is the 5' end; the left-hand direction of double-stranded polynucleotide sequences is referred to as the 5' direction. The direction of 5' to 3' addition of nascent RNA transcripts is referred to as the transcription direction; sequence regions on the DNA strand having the same sequence as the RNA and which are 5' to the 5' end of the RNA transcript are referred to as "upstream sequences"; sequence regions on the DNA strand having the same sequence as the RNA and which are 3' to the 3' end of the RNA transcript are referred to as "downstream sequences."

Conservative amino acid substitutions can encompass non-naturally occurring amino acid residues, which are typically incorporated by chemical peptide synthesis rather than by synthesis in biological systems. These include peptidomimetics and other reversed or inverted forms of amino acid moieties.

As disclosed elsewhere herein, naturally occurring residues can be divided into classes based on common side chain properties:

1) hydrophobic: norleucine, Met, Ala, Val, Leu, Ile;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

For example, non-conservative substitutions can involve the exchange of a member of one of these classes for a member from another class. Such substituted residues can be introduced, for example, into regions of a human antibody that are homologous with non-human antibodies, or into the non-homologous regions of the molecule.

In making changes to the protein domains specified herein, according to certain embodiments, the hydropathic index of amino acids can be considered. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is understood in the art. Kyte et al., J. Mol. Biol., 157:105-131 (1982). It is known that certain amino acids can be substituted for other amino acids having a similar hydropathic index or score and still retain a similar biological activity. In making changes based upon the hydropathic index, in certain embodiments, the substitution of amino acids whose hydropathic indices are within ±2 is included. In certain embodiments, those which are within ±1 are included, and in certain embodiments, those within ±0.5 are included.

It is also understood in the art that the substitution of like amino acids can be made effectively on the basis of hydrophilicity, particularly where the biologically functional protein or peptide thereby created is intended for use in immunological embodiments, as in the present case. In certain embodiments, the greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in certain embodiments, those which are within ±1 are included, and in certain embodiments, those within ±0.5 are included. One can also identify epitopes from primary amino acid sequences on the basis of hydrophilicity. These regions are also referred to as "epitopic core regions."

Devices

Figure 10A:
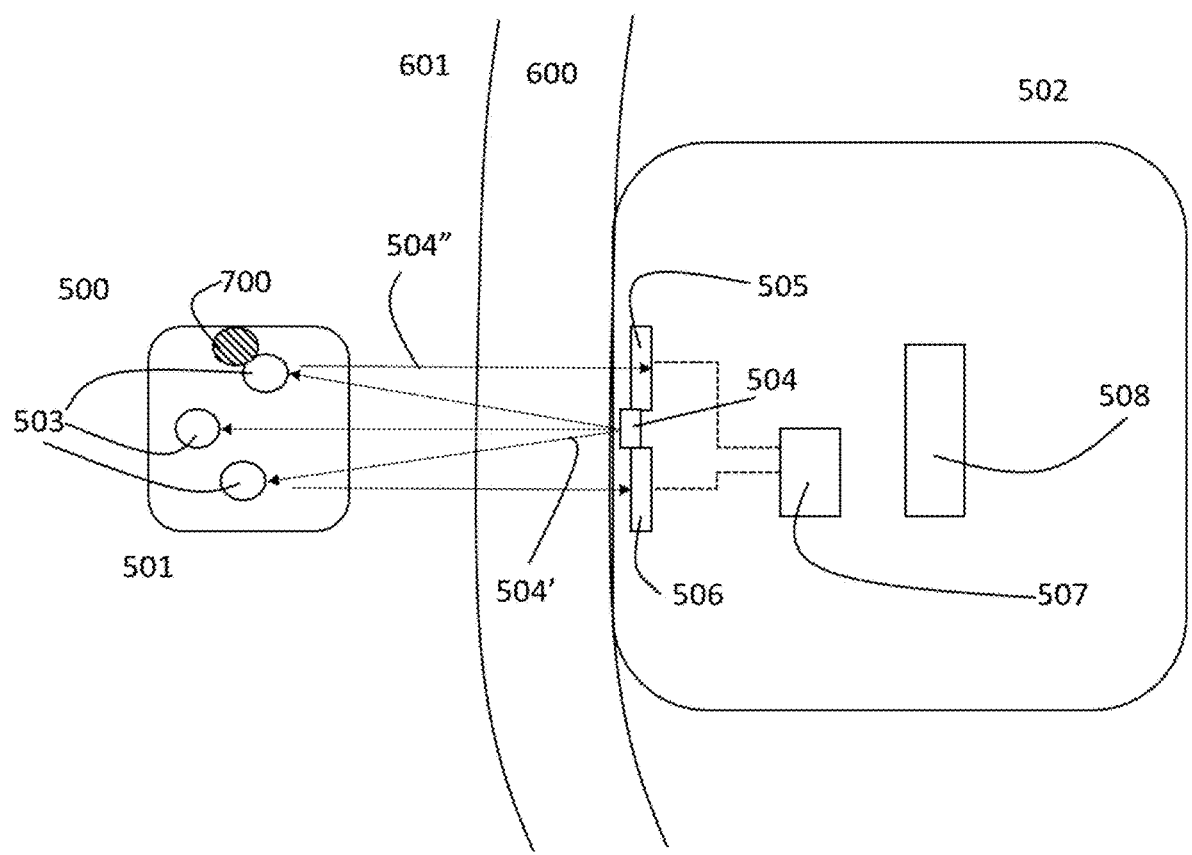
FIG. 10A depicts an embodiment of a sensor and an interrogating device.

Some embodiments pertain to a device that may comprise one or more indicator compounds as disclosed herein. In some embodiments, the device is a sensor, as shown in FIG. 10A. In some embodiments, the sensor 500 is implanted into the body of a subject in need of monitoring and/or treatment (e.g., a diabetic patient, a pre-diabetic patient, or another patient in need of monitoring). In some embodiments, as shown in FIG. 10A, the sensor is an implant. In some embodiments, the sensor 500 that is inserted under the epidermis 600 and into the dermis 601. In some embodiments, an indicator compound 503 of the sensor allows the detection of an analyte 600 (e.g., glucose) and/or allows quantification of an amount of an analyte. In some embodiments, the sensor may be interrogated with electromagnetic radiation (e.g., an optical signal such as light radiation). In some embodiments, an optical signal 504″ (e.g., fluorescence) is used to illuminate the sensor 500. In some embodiments, as disclosed elsewhere herein, the illuminated sensor 500 provides fluoresces to provide a return optical signal 504″. In some embodiments, the optical signal 504″ generated by the sensor 500 may be detected transcutaneously (e.g., through the skin and/or via the upper layers of the skin). In some embodiments, for example, a interrogating device 502 is used to illuminate the sensor through the skin. In some embodiments, the interrogating device 502 is also (or alternatively) used to collect a signal 504″ from the sensor through the skin. In some embodiments, this configuration allows direct communication between the sensor 500 to the external environment. For example, the patient may bring the interrogating device into proximity to the sensor at which point the interrogating device interrogates the sensor to provide data regarding the amount of the analyte present. In some embodiments, this is a particular advantageous in connection with the long-term care of diabetic patients. In some embodiments, once the sensor 500 is in place within and/or under the skin, readings of the analyte are read as often as needed (e.g., by a user including the patient, medical personnel, etc.). In some embodiments, the sensor allows frequent reading of analyte (e.g., glucose) measurement and more precise control of the analyte levels (e.g., blood glucose levels) in the body. For example, by providing more continuous measurement of glucose levels, high glucose levels can be better avoided. Avoiding the higher the blood glucose level can allow the patient to delay or avoid the onset of related conditions, such as retinopathy, arthritis and circulatory deterioration. In some embodiments, the risk of developing symptoms associated with poor analyte control can be reduced.

In some embodiments, as shown in FIG. 10A, the sensor 500 does not itself contain any optical components. In some embodiments, these components are provided separately (e.g., are also extracorporeal). In some embodiments, the sensor 500 is configured to be interrogated by a light-emitting device 502 that produces a light signal 504′ (e.g., from an light emitting diode, laser, etc.). In some embodiments, the light emitting device 502 is ambulatory (e.g., hand-held device). In several embodiments, the light source 504 of the device is configured for use in performing remote interrogation of the sensor device. In some embodiments, the light emitting device includes excitation light filters, such as one or more light emitting diodes 504 (dichroic or dye filters).

In several embodiments, the light emitting device 502 also is configured to receive a signal from the sensor. In several embodiments, as shown in FIG. 10A, the light emitting device 502 may include one or more a fluorescence detectors 505, 506 (e.g., as part of a fluorimeter). In some embodiments, the light emitting device comprises a fluorimeter. In some embodiments, the fluorimeter is configured to measure picomolar to femtomolar concentrations of a fluorescent signal from the indicator compound. In some embodiments, as shown, measurement the amount of analyte is performed by holding the fluorimeter close to the skin or against the skin.

When transcutaneously measuring the fluorescence signal generated inside the sensor, it may be necessary to consider the absorption of the signal by the skin. In several embodiments, the absorption of human skin is corrected for (e.g., separated from the signal received) to allow quantification of the signal.

In some embodiments, as shown, the sensor also generates a reference signal measured by a reference filter 506. This reference signal can be deducted from the read filter detector 505 to provide a calibrated signal. The reference signal can be generated by measuring baseline signal from an indicator compound that is not bound by an analyte. In several embodiments, the signals 504′, 504″ are received by an encoder 507 that provides data regarding the analyte level to a transmitter 508. In several embodiments, the transmitter communicates with a signal a receiver that may be outside the interrogating device or inside the interrogating device. In several embodiments, the internal unit (e.g., the sensor 500) does not require a power source, as it is interrogated using light from the external unit. In some embodiments, the light emitting device 502 is also a receiver for the signal produced by the sensor. In some embodiments, the receiver 508 communicates with a display to produce a readout indicating a level of analyte present. In several embodiments, the display can be read by the patient or a medical practitioner. In several embodiments, the receiver transmits the signal (e.g., wirelessly through, for example, blue tooth, etc.) to a handheld device (e.g., a smart phone, tablet, etc.). In several embodiments, alternatively, the interrogating device is a handheld device.

In some embodiments, as disclosed elsewhere herein and as shown in FIG. 10A, the sensor may comprise a matrix material in which the indicator compound resides 501. Alternatively, in some embodiments, not shown, the indicator compound may be bound to an outer surface of the sensor. In several embodiments, the indicator compound may be bound within the and/or to the matrix material 501 covalently, through dative bonds, van der Waals forces or the like. In several embodiments the matrix material is a biocompatible material. In several embodiments the matrix material is a hydrogel. In several embodiments, the hydrogel is configured to allow transmission of the analyte in and out of the matrix material. In some embodiments, the fast diffusion (e.g., diffusion controlled) transportation of the analyte through the matrix allows real-time monitoring of the analyte concentration in the body. In several embodiments, hydrogels can be prepared using conventional means, including but not limited to polymerizing one or more monomers with a multifunctional crosslinking agent. Some polymers that may be provided as hydrogels include crosslinked: proteins, peptides, and biological molecules (including polymers such as human albumin, fibrin gel, etc.), polysaccharides (including but not limited to those produced from arabinoxylans, starch, agarose, cellulose, chitin, alginates, hyaluronate, etc.) and derivatives thereof, poly(lactide-co-glycolide), poly(ethylene glycol) (PEG), poly(L-lactic acid) (PLA), poly(glycolic acid) (PGA), polyhydroxybutyrate (PHB), polyhydroxyvalerate (PHV), copolymers of PHB and PHV, polycaprolactone, polyanhydrides, polyhydroxybuterate, poly(vinyl alcohol), poly(N-vinyl pyrrolidone), poly(octamethylene citrate) (POC), poly(octamethylene maleate citrate) (POMC), polycarboxylic acids (such as polymethacrylic acid, glutamic acid and aspartic acid containing proteins and peptide polymers, etc.), polyamines (such as lysine containing proteins and peptide polymers, etc.), mixtures or copolymers of any of the foregoing, or others.

Figure 10B:
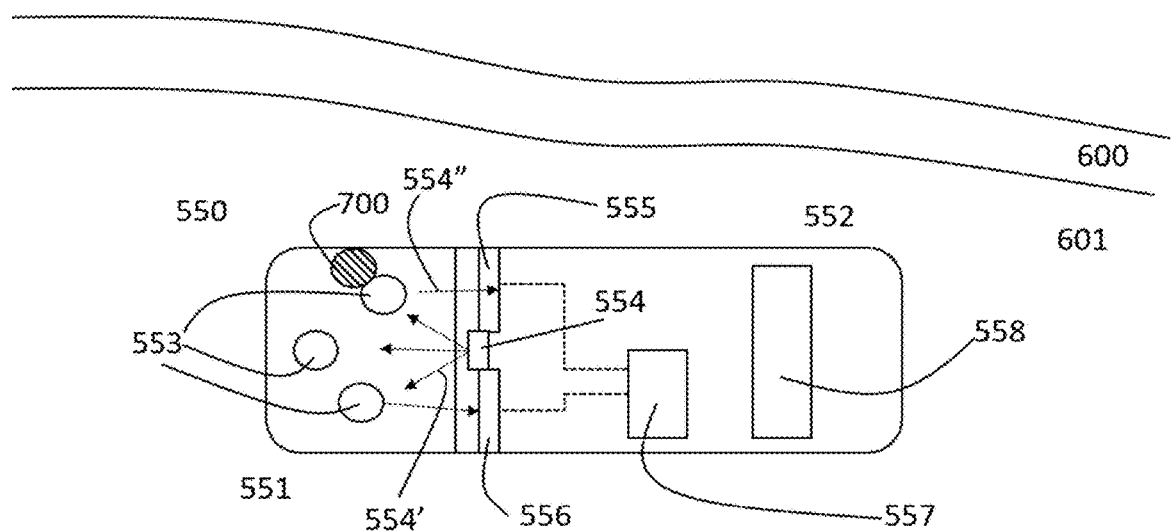
FIG. 10B depicts another embodiment of a sensor.

Another embodiment is shown in FIG. 10B. Similar features for the separate embodiments of FIGS. 10A and 10B can comprise one or more coinciding features offset numerically by a factor of 50 but otherwise having the same numerical value. For example, features of one sensor 500 and its matrix material 501 may be similar or the same as features the second sensor 550 and its matrix material 551.

In some embodiments, as shown in FIG. 10B, the optical components including optoelectronic features may be provided in the sensor 550 (and/or in the implant). In some embodiments, the optical components may be configured to provide a signal 559 that transmitted from the transmitter 558 and is received by a receiver outside the patient. In some embodiments, the sensor may comprise optical components that produce a fluorescent signal 554" by interrogating a portion of the sensor 550 having the indicator compound 553 embedded in a matrix material 551. For example, the sensor may include a light source (e.g., an light emitting diode) that excites the indicator compound (or different indicator compounds) of the sensor. In some embodiments, the implanted sensor 550 comprises a fluorimeter. In such an embodiment, the sensor may produce a signal that is transmitted outside the body and received by a receiver.

In some embodiments, the optoelectronics circuitry of the implant 550 obtains quantitative measurement information and modifies a load as a function of the obtained information. In some embodiments, as disclose in U.S. Pat. No. 6,400,974 the load may vary the amount of current through for example a coil. Alternatively, the internal device may comprise another power source (e.g., a battery, etc.). For the system of FIG. 10B, the coil 558 may be internal and may be coupled to a coil of the external unit. An amplitude modulation (AM) demodulator, detects the current variations induced in coil and applies the detected signal to processing circuitry, such as a pulse counter and computer interface, for processing the signal into computer-readable format for inputting to, for example, a computer. In some embodiments, a variable RF oscillator provides an radiofrequency (RF) signal to coil, which in turn provides electromagnetic energy to coil an external coil, when the coils are within close enough proximity to each other to allow sufficient inductive coupling between the coils. The energy from the RF signal provides operating power for the internal unit to obtain quantitative measurements, which are used to vary the load and in turn provide a load variation to the coil that is detected by the external unit and decoded into information. In some embodiments, the sensor is provided in a shape that can be injected into the subject's body (e.g., patient's body). In some embodiments, the sensor is surgically inserted into the body of a patient. In some embodiments, as disclosed elsewhere herein, the indicator compound is incorporated into a matrix material that is permeable to skin fluids, such that analytes such as glucose penetrate into the sensor by reduced diffusion and also form components of the assay. It makes it possible to interact with the components. The matrix material may be an injectable formulation that forms a gel at the point of injection in the patient's skin. In some embodiments, alternatively, the sensor is formed from a solid polymeric matrix material injected into the skin In some embodiments, the sensor may be biodegradable or hydrolysable in vivo. In some embodiments, the sensor is not degradable. The reason for this is that natural growth and replacement processes inside the skin cause the epidermis in which the sensor is embedded to fall off, so that this sensor also eventually excretes and falls off with the epidermis. In several embodiments, the degradation rate of the sensor can be matched to the lifetime of the indicator compound. Once this sensor no longer functions effectively to monitor the analyte (e.g., due to photobleaching, etc.), a new sensor may be implanted, and there is no need to surgically remove the old sensor. In some embodiments, non-biodegradable materials can also be used.

Figure 10C:
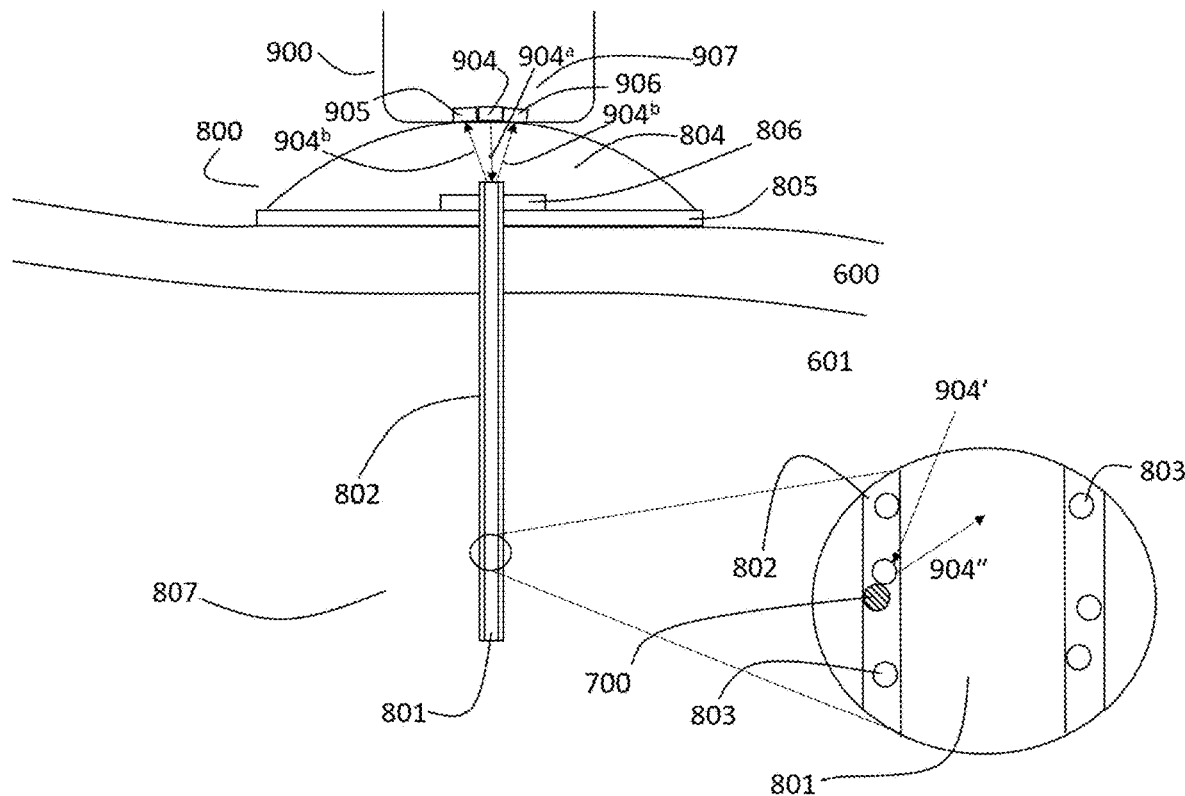
FIG. 10C depicts an embodiment of a sensor having a waveguide.

A hurdle that has greatly hindered biomedical optical technologies, is the turbidity of biological tissues. Due to significant scattering and absorption loss, light often cannot be delivered to or collected from target regions within tissues. Implanting fiber optical waveguide in tissues or organs for light delivery or collection may be an effective method for alleviating this problem. FIG. 10C provides another embodiment of a sensor that addresses these problems or others. In some embodiments, the sensor 800 comprises a waveguide fiber 807 (e.g., fiber optic portion) that is embedded under the skin of a subject in need of monitoring and/or treatment (e.g., a diabetic patient, a pre-diabetic patient, or another patient in need of monitoring). In some embodiments, as shown in FIG. 10C, the wave guide 807 protrudes under the epidermis 600 and into the dermis 601. In some embodiments, the sensor is adhered to the skin via an adhesive layer 805. As shown, the waveguide may comprise a flange 806 that adheres it to the adhesive layer 805 to hold in place. In some embodiments, an indicator compound 803 of the sensor allows the detection of an analyte 700 (e.g., glucose) or measuring the amount of an analyte. In some embodiments, the reading of the measurement is provided as an optical signal 904b (e.g., fluorescence). In some embodiments, the optical signal 904b generated by the sensor 800 are detected at a surface of a light transmissive substrate 804 of the sensor 800. In some embodiments, as shown, the transmissive substrate 804 of the sensor 800 is dome shaped to allow multiple signals to be measured about the transmissive substrate 804 simultaneously. In some embodiments, this configuration allows direct communication between the sensor 800 to the external environment. In some embodiments, once the sensor 800 is in place within the skin, the readings of the analyte are read as often as needed (e.g., by a user including the patient, medical personnel, etc.).

In some embodiments, as shown in FIG. 10C, the sensor 800 does not itself contain any optical components. In some embodiments, these components are provided separately (e.g., in a light-emitting device 900). In some embodiments, the sensor is configured to be interrogated by a light-emitting device 900 that produces a light signal 904a (e.g., from a light emitting diode, laser, etc.). In some embodiments, the light emitting device 900 is ambulatory (e.g., handheld device). In several embodiments, the light source 904 of the device is configured for use in performing remote interrogation of the sensor device. In some embodiments, the light emitting device includes excitation light filters, such as one or more light emitting diodes 904 (dichroic or dye filters). In several embodiments, the light emitting device 900 also includes one or more a fluorescence detectors 905, 906. Though shown with only one in FIG. 10C, multiple detectors and light sources (e.g., detection assemblies 907) can be provided in the light emitting device, including light sources with different wavelengths of light configured to interrogate differing indicator compounds. These light source and detector modules may be positioned to interact with the transmissive substrate at various positions about the transmissive substrate. In several embodiments, as disclosed herein, the light transmissive substrate 804 of the sensor 800 is a light transmissive polymer. In some embodiments, the light transmissive substrate is a medical grade polymer, such as medical grade silicon.

In some embodiments, the light emitting device comprises a fluorimeter (and/or is a fluorimeter). In some embodiments, the fluorimeter is configured to measure picomolar to femtomolar concentrations of a fluorescent signal from the indicator compound. In some embodiments, as shown, measurement the amount of analyte is performed by holding the fluorimeter close to and/or against the skin light transmissive substrate 804. In some embodiments, the sensor also generates a reference signal measured by a reference filter 906. This reference signal can be deducted from the read filter detector 905 to provide a calibrated signal. In some embodiments, the sensor does not generate a reference signal and/or lacks a detector configured to measure the reference signal. In several embodiments, the signals are transmitted to an encoder that communicates with a receiver (not shown). In some embodiments, the light emitting device is also a receiver for the signal produced by the sensor. In some embodiments, the receiver produces a readout indicating a level of analyte present that can be read by the patient or a medical practitioner. In several embodiments, the receiver transmits the signal (e.g., wirelessly through, for example, blue tooth, etc.) to a handheld device (e.g., a smart phone, tablet, etc.). In several embodiments, alternatively, the light emitting device is the handheld device (e.g., a smart phone, tablet, etc.).

Figure 10D:
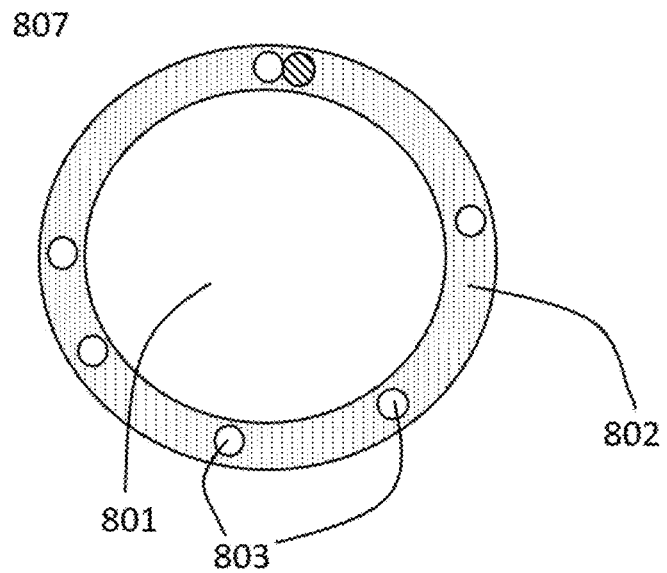
FIG. 10D depicts an embodiment a bottom view of the waveguide of FIG. 10C.

In some embodiments, as disclosed elsewhere herein and as shown in FIGS. 10C and 10D (which is a cross-sectional view of a section of the fiber 807), the sensor may comprise a matrix material 802 in which the indicator compound resides. Alternatively, in some embodiments, not shown, the indicator compound may be bound to an outer surface of the sensor (e.g., an outer surface of the matrix material 802). In several embodiments, the indicator compound may be bound within the and/or to the matrix material 802 covalently, through dative bonds, van der Waals forces or the like. In several embodiments the matrix material is a biocompatible material. In several embodiments the matrix material is a hydrogel. In several embodiments, the hydrogel allows transmission of the analyte in and out of the matrix material. In some embodiments, the fast diffusion (e.g., diffusion controlled) transportation of the analyte through the matrix allows real-time monitoring of the analyte concentration in the body. In some embodiments, the fiber also comprises a core 801 that transmits the signal through the fiber.

In some embodiments, the waveguides are made from single polymer materials. In some embodiments, the wave guides are made from combinations of materials (e.g., having a core structure as shown in FIG. 10C). Materials such as poly(ethylene glycol) (PEG), silk, agarose gel, and poly(L-lactic acid) (PLA) may be used, as well as hydrogels as disclosed herein. However, due to the lack of an intrinsic cladding layer, single material waveguides tend to have high loss, resulting from significant interaction of the guided optical wave with surrounding medium (such as tissues in vivo). In some embodiments, to address this issue, a biocompatible step-index fiber optical waveguide as shown in FIG. 10C is shown.

In some embodiments, the fiber comprises, consists of, or consists essentially of a polymer core 801 and cladding layer 802 (as shown in FIGS. 10C and 10D). An expanded view of the polymer core 801 and the cladding layer is shown in FIG. 10C. In some embodiments, the fiber is a biocompatible and biodegradable step-index optical fiber (having a core of one refractive index and a cladding layer of a separate refractive index.

In some embodiments, the fiber may comprise, PEG (polyethylene glycol), an alginate hydrogel, a polyacrylamide hydrogel, an alginate-polyacrylamide hydrogel, a silk, citrate-based polymeric elastomer (including one or more of poly(octamethylene citrate) (POC), poly(octamethylene maleate citrate) (POMC)), mixtures of any of foregoing, and/or combinations of any of the foregoing. These materials may be in either the cladding layer or the core layer. In some embodiments, the waveguide comprises, consists of, or consists essentially of a citrate-based polymeric elastomer. Crosslinkable elastomeric polymers can be synthesized by reacting the multifunctional citric acid with different diols and/or amino acids via a facile polycondensation reaction. Unlike natural materials (e.g., silk) or traditional synthetic polymers (e.g., poly lactic-co-glycolic acid (PLGA)) that usually have limited tunability for key optical, mechanical, and/or degradation properties, the family of citrate-based biodegradable elastomers possesses tunable mechanical strengths (from tens of Pascal to mega Pascal), programmable degradation rates (from a few days to over a year), reactive nature between citrate-based polymers, multifunctionalities (e.g., adhesive, fluorescent), and ultrafine tuning of refractive index ($\sim 10^{-3}$). Citrate-based elastomers can be used as implant materials and serve as a platform for the development of fully biodegradable and seamlessly integrated step-index optical fibers for in vivo applications. In several embodiments, POC is used as the cladding outer layer 802 and POMC is used as a core material 801.

Figure 10E:
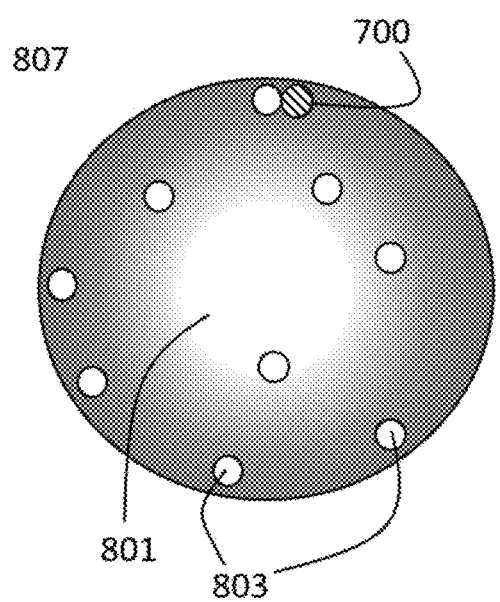
FIG. 10E depicts an embodiment of a waveguide having a polymer gradient.

In some embodiments, additional configurations are possible. In some embodiments, as shown in FIG. 10E, the waveguide may be a gradient copolymer with an internal area protected by a cladding outer area.

Figure 10F:
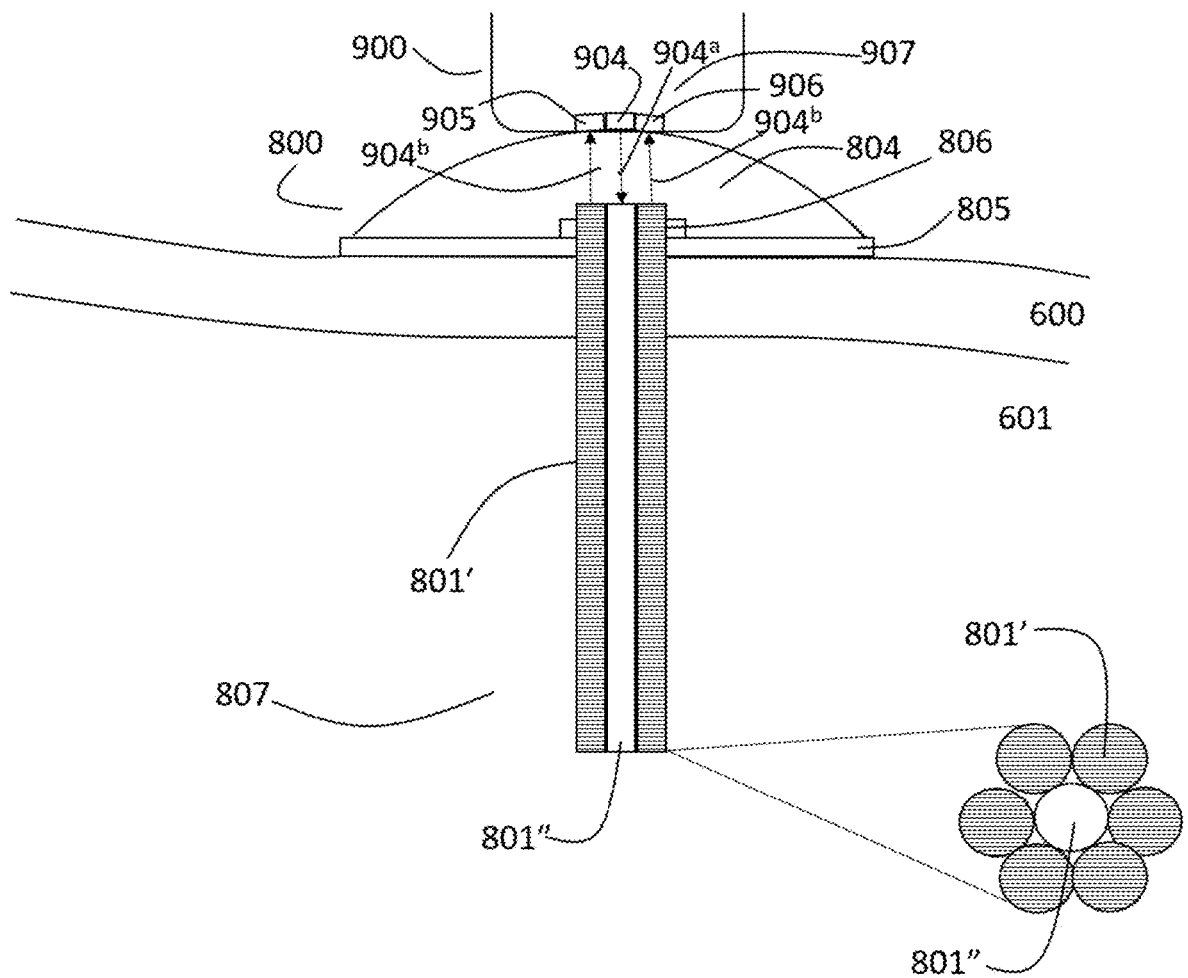
FIG. 10F depict an embodiment of a sensor having a waveguide the comprises multiple polymer fibers.
Figure 10G:
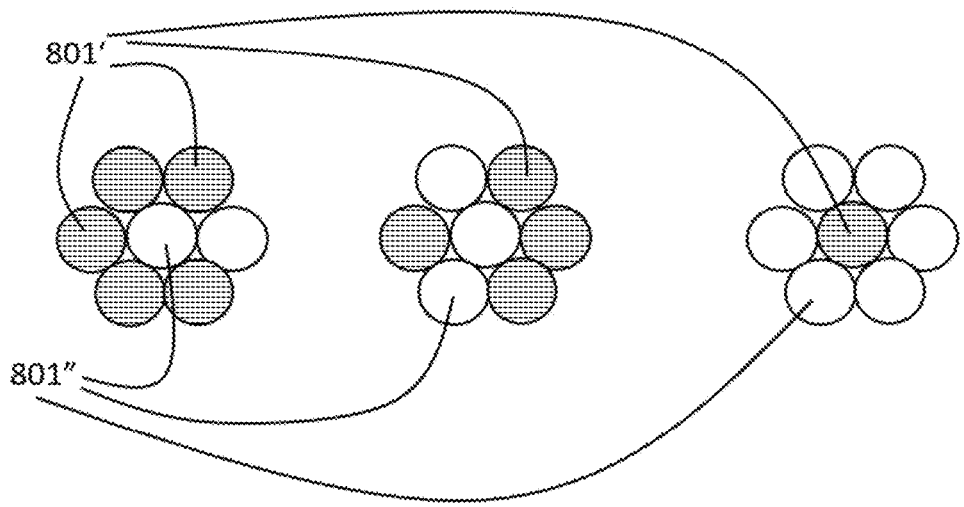
FIG. 10G depicts additional embodiments of waveguides comprising multiple polymer fibers.

In some embodiments, as shown in FIG. 10F, the waveguide may comprise multiple fibers (equal to or greater than at least about 2, 3, 4, 5, 6, 10, 20 fibers (or ranges including and/or spanning any of the aforementioned values) as a fiber bundler. In some embodiments, the fiber bundle may comprise one or more excitation fibers 801" that receive the radiation (e.g., light) from the light source 904 and one or more collection fibers 801' that transmit radiation (e.g., fluorescent light) to the detector 905, 906. In several embodiments, as shown in FIG. 10F, the excitation fiber may be surrounded by a plurality of collection fibers. In several embodiments, as shown in FIG. 10G, other fiber configurations are possible, including a random distribution or a distribution of excitation fibers surrounding collection fibers. In several embodiments, the indicator compound may be positioned in the excitation fiber, the collection fiber, at the surface of the excitation fiber and/or collection fibers, and/or at any combination of the aforementioned positions.

Figure 10H:
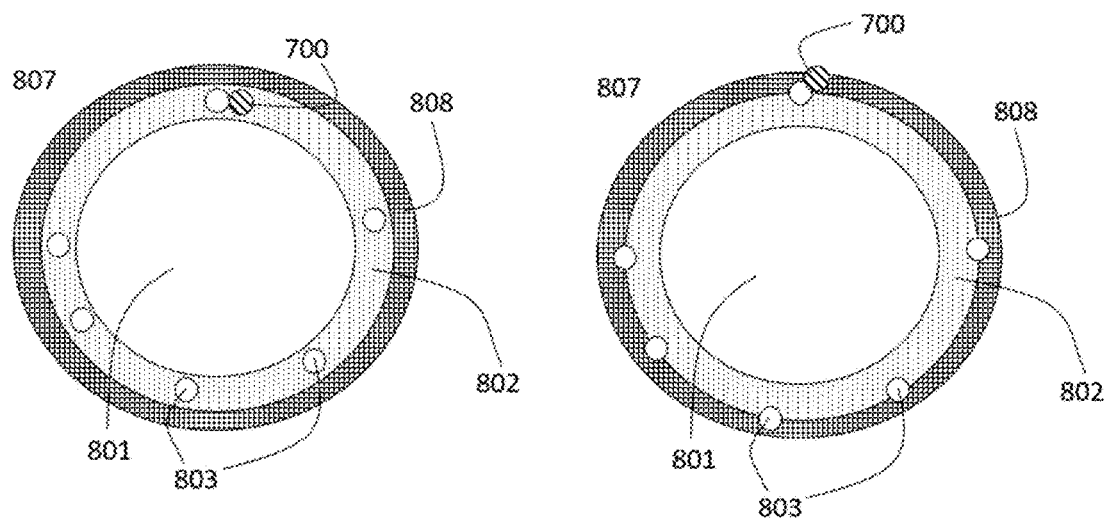
FIG. 10H depicts a waveguide having a protective coating.

In several embodiments, as provided in FIG. 10H, and additional coating 808 (e.g., polymer coating) may be provided over the waveguide. In several embodiments, the coating shields the indicator compound from the environment surrounding the waveguide (protecting it). In several embodiments, the indicator compound can be distributed between the core and the matrix material (e.g., at the interface), in the matrix material 802, or at the interface of the matrix material and the protective coating 808.

Figure 10I:
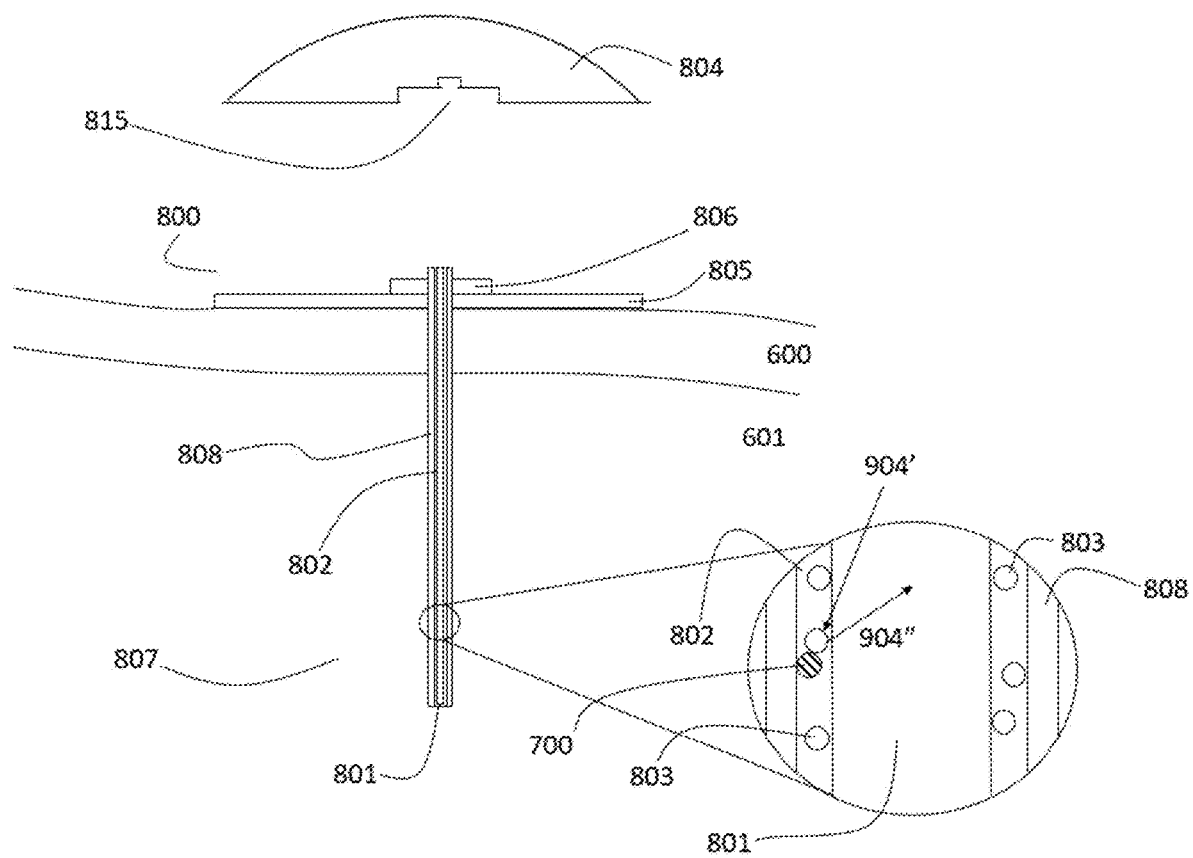
FIG. 10I depicts a waveguide being assembled.

In several embodiments, the sensor 800 can be placed within the skin of a patient using an inserter. In several embodiments, as show in FIG. 10I (showing an embodiment with a coated waveguide as in FIG. 10H), the transmissive substrate 804 can be placed over the waveguide after insertion of the waveguide 807 beneath the skin. In several embodiments, the transmissive substrate 804 adheres to the adhesive layer 805 to couple the transmissive substrate 804 to the adhesive layer. As shown, the transmissive substrate may have a notch 815 configured to receive a portion of the flange 806 and waveguide 807 that protrude from the adhesive layer 805.

Figure 10J:
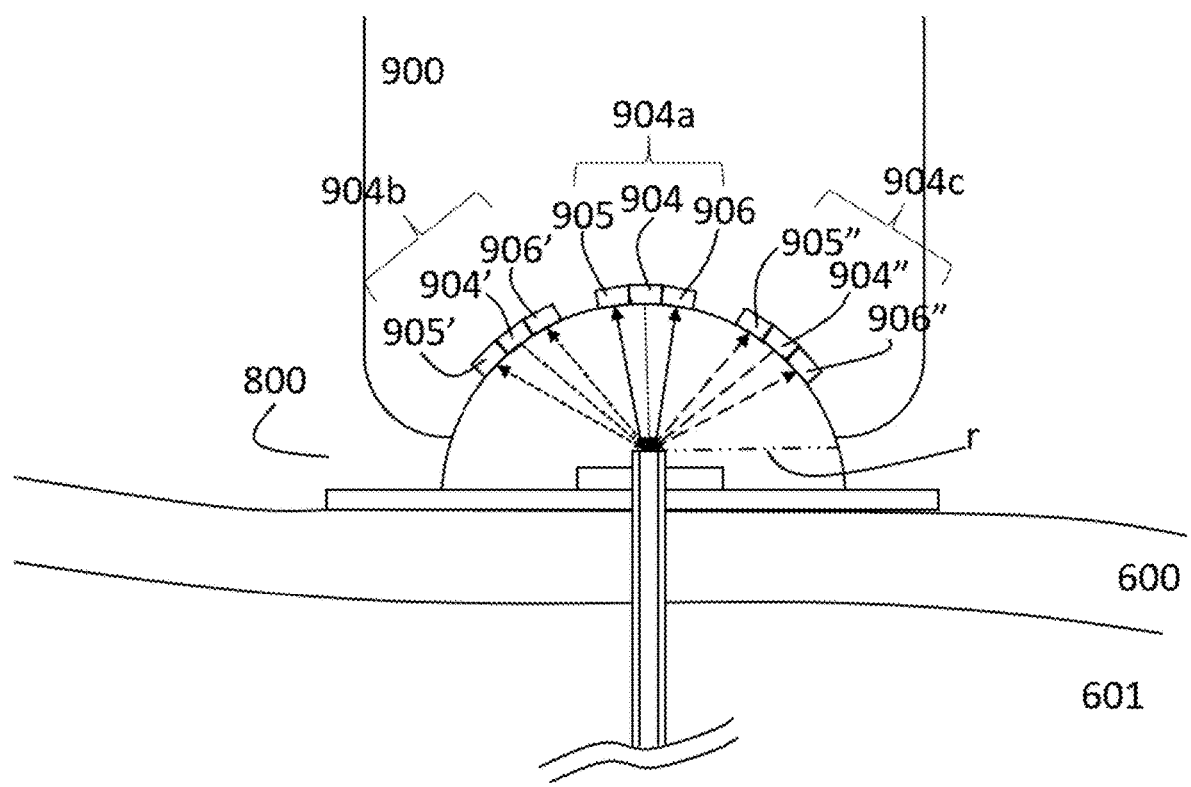
FIG. 10J provides another embodiment of a waveguide.

FIG. 10J shows an embodiment of a sensor being interrogated by a light emitting device with multiple detection assemblies 904a, 904b, 904c. As shown, each assembly, 904a, 904b, 904c, comprises a light source 904, 904', 904" and one or more a fluorescence detectors 905, 906, 905', 906', 905", 906". The light assemblies can be configured to interrogate the same indicator compound (e.g., each may have the same excitation wavelength and detection wavelength) different indicator compounds (e.g., each may have the same excitation wavelength and detection wavelength). Where multiple different indicator compounds are used in the waveguide (or in the matrix material as disclosed elsewhere herein), the indicator compounds may be for the same analyte (e.g., to provide multiple different data points for a single analyte such as glucose) or for different analytes. In some embodiments, each assembly may be activated simultaneously. In other embodiments, each assembly may be activated at a different time (including serially). By interrogating the sensors at different time points, less heating of the sensor may occur. In some embodiments, the sensor may include heat dissipating devices (e.g., a heat sink, peltier devices, etc.)

In some embodiments, the waveguide may have indicator compounds distributed homogeneously throughout the matrix material 802. In some embodiments, the indicator compound may be distributed heterogeneously down the length or axially within the waveguide. For example, in some embodiments, the indicator compound may have a higher concentration toward the center of the waveguide. In some embodiments, the waveguide may have a higher concentration at the distal tip of the waveguide (distal to the light transmissive substrate 804). In other embodiments, the waveguide may have a higher concentration at the proximal section of the waveguide (proximal to the light transmissive substrate 804).

In several embodiments, the waveguide is a length suitable to extend through the epidermis and into the dermis. In several embodiments, the waveguide is a length equal to or at least about: 1 mm, 2 mm, 3 mm, 4 mm, or ranges including and/or spanning the aforementioned values. In several embodiments, the waveguide has a thickness (e.g., diameter) equal to or at least about: 25 µm, 50 µm, 75 µm, 100 µm, 150 µm, or ranges including and/or spanning the aforementioned values. In several embodiments, the core of the waveguide has a thickness equal to or at least about: 25 µm, 50 µm, 75 µm, 100 µm, or ranges including and/or spanning the aforementioned values. In several embodiments, the matrix material around the core of the waveguide has a thickness equal to or at least about: 5 µm, 10 µm, 15 µm, 25 µm, or ranges including and/or spanning the aforementioned values. In several embodiments, where present, the protective coating for the waveguide has a thickness equal to or at least about: 2.5 µm, 5 µm, 10 µm, 15 µm, 25 µm, or ranges including and/or spanning the aforementioned values. In several embodiments, the waveguide is a length suitable to extend through the epidermis and into the dermis. In several embodiments, the transmissive substrate is circular or semicircular when viewed from the top. In several embodiments, the diameter of the transmissive substrate is equal to or at least about: 10 mm, 15 mm, 20 mm, 30 mm, or ranges including and/or spanning the aforementioned values. In several embodiments, where the waveguide comprises multiple fibers (e.g., a bundle), each individual fiber may have a thickness (e.g., diameter) equal to or at least about: 10 µm, 15 µm, 25 µm, 50 µm, or ranges including and/or spanning the aforementioned values.

In several embodiments, the matrix material has a refractive index of equal to or less than about: 1.20, 1.30, 1.40, 1.49, 1.50, 1.60, or ranges including and/or spanning the aforementioned values. In several embodiments, the core has a refractive index of equal to or less than about: 1.20, 1.30, 1.40, 1.49, 1.50, 1.60, or ranges including and/or spanning the aforementioned values. In some embodiments, the refractive index of the matrix material and the core differ by less than equal to or less than about: 0.01, 0.05, 0.10, 0.20, or ranges including and/or spanning the aforementioned values.

In several embodiments, as shown, the light transmissive material of the waveguide sensor may be dome shaped. In other embodiments, the light transmissive material need not be dome shaped. In several embodiments, where the light transmissive material of device of FIG. 10C-10J is dome shaped, the radius of curvature of the light transmissive material may a length sufficient to focus the emitted light signal at the proximal end of the waveguide. As shown in FIG. 10J, the radius of curvature of the light transmissive material may be a length that matches (or substantially matches) the distance from the proximal end of the waveguide to the peripheral surface of the transmissive material.

Suitable optical signals that can be used as an analytical readout in accordance with the present invention include, for example, fluorescence resonance energy transfer, fluorescence polarization, fluorescence quenching, phosphorescence, luminescence enhancement, luminescence quenching, diffraction or plasmon resonance, and the like. All optical signals that can be generated by approximation assays known per se in the art are included.

Some embodiments pertain to systems. In some embodiments, the system includes internal or partially internal unit 500, 550, 800, and an external unit 502, 900. In some embodiments, the internal unit would be implanted either subcutaneously or otherwise within the body of a subject. In some embodiments, the internal unit contains optoelectronics circuitry, a component of which may be comprised of a fluorescence sensing device as described with reference to FIGS. 10A-10C.

Various components for implantable sensors and systems incorporated such sensors have been described in U.S. Pat. Nos. 6,400,974; 6,794,195; 7,800,078; 7,713,745; 7,375,347; 9,717,413; 7,060,503; 7,157,723; 7,190,445; 7,227,156; 7,939,332; 7,405,387; 7,851,225; 7,822,450; 8,502,167; 8,143,068; 9,693,714; 9,681,824; 9,498,156; 9,717,413; 10,111,588 9,931,068; 9,414,775; 9,814,389; 9,867,540; 9,778,190; 9,743,869; 10,119,911; 10,662,333; and U.S. Application Publication No. 2014/0088383, each of which is incorporated by reference herein in its entirety.

Methods of Manufacture

Methods for preparing a fusion of the protein portions comprised in the fusion protein are known to those skilled in the art and are described in the literature. Preferably, such fusions are carried out by recombinant techniques, i.e. by combining nucleic acid molecules encoding the respective portions of the fusion protein, e.g., by classical cloning techniques, by in vitro techniques such as PCR or by chemical synthesis or by combinations of these techniques, followed by the expression of the fusion protein from the recombinant nucleic acid molecule. Other methods for producing protein fusions may be applied as well, such as the introduction of chemical linkages between polypeptides. A connection between a signaling domain and the binding domain may be either direct or indirect (e.g., via a polypeptide stretch lying between these portions such as a linker peptide). This linker may be used to bring the two detection portions into relative positions in order to allow or improve the change of energy emission such as the change of FRET of the detection portions upon binding of a compound.

In some embodiments, variants are encoded by a nucleotide sequence which hybridizes, including under stringent conditions with a nucleotide sequence encoding a binding and/or signaling protein as described above. For such variants, the hybridization conditions and sequence identities likewise apply. Binding and/or signaling proteins and/or variants may be modified by addition, deletion, shuffling, substitution (e.g., by conservative amino acid substitution) and the like with respect to a naturally occurring binding and/or signaling proteins. For instance, such alterations may be introduced in order to adapt a coding sequence to a certain codon usage of a given host organism or to modify the binding properties, i.e. the specificity for the compound or the binding affinity, or to improve the three-dimensional structure, e.g. the relative position and topology of the detection portions contained in the fusion protein and/or to improve the change in resonance energy transfer ratio or to increase the insensitivity to ionic conditions, e.g. the pH. Techniques of determining variant properties include X-ray crystallography, NMR studies, modelling etc. and whether it undergoes a conformational change upon binding of a compound.

In some embodiments, the invention relates to a method for producing cells capable of expressing the fusion protein, as disclosed herein, comprising genetically engineering cells with an above-described nucleic acid molecule, expression cassette or vector, as disclosed herein. Another embodiment, as disclosed herein, relates to host cells, in particular prokaryotic or eukaryotic cells, genetically engineered with an above-described nucleic acid molecule, expression cassette or vector, and to cells descended from such transformed cells and containing a nucleic acid molecule, expression cassette or vector and to cells obtainable by the above-mentioned method for producing the same.

In some embodiments, transgenic human cells or tissues are made using the techniques disclosed herein. In some embodiments, those tissues (e.g., a section of skin), can be implanted back onto a human (autologous or allogeneic) to allow analyte detection. For instance, a skin graft using a patient's own skin cells that are transgenic to the patient can be reintroduced to the patient (e.g., on his or her arm, leg, stomach, etc.) to provide a patch of skin that allows analyte detection and observation in a non-invasive manner. These transgenic tissues and cells can be made using the techniques described elsewhere herein.

In some embodiments, these host cells are bacterial, fungal, insect, plant or animal host cells. In some embodiments, the host cell is genetically engineered in such a way that it contains the introduced nucleic acid molecule stably integrated into the genome. In some embodiments, the nucleic acid molecule can be expressed so as to lead to the production of the fusion protein, as disclosed herein.

An overview of different expression systems is for instance contained in Methods in Enzymology 153 (1987), 385-516, in Bitter et al. (Methods in Enzymology 153 (1987), 516-544) and in Sawers et al. (Applied Microbiology and Biotechnology 46 (1996), 1-9), Billman-Jacobe (Current Opinion in Biotechnology 7 (1996), 500-4), Hockney (Trends in Biotechnology 12 (1994), 456-463), Griffiths et al., (Methods in Molecular Biology 75 (1997), 427-440). An overview of yeast expression systems is for instance given by Hensing et al. (Antoine von Leuwenhoek 67 (1995), 261-279), Bussineau (Developments in Biological Standardization 83 (1994), 13-19), Gellissen et al. (Antoine van Leuwenhoek 62 (1992), 79-93, Fleer (Current Opinion in Biotechnology 3 (1992), 486-496), Vedvick (Current Opinion in Biotechnology 2 (1991), 742-745) and Buckholz (Bio/Technology 9 (1991), 1067-1072). Expression vectors have been described in the literature. In some embodiments, they contain not only a selection marker gene and a replication origin ensuring replication in the host selected, but also a bacterial or viral promoter and, in most cases, a termination signal for transcription. In some embodiments, between the promoter and the termination signal, there is in general at least one restriction site or a polylinker which enables the insertion of a coding nucleotide sequence. It is possible to use promoters ensuring constitutive expression of the gene and inducible promoters which permit a deliberate control of the expression of the gene. Bacterial and viral promoter sequences possessing these properties are described in detail in the literature. Regulatory sequences for the expression in microorganisms (for instance E. coli, S. cerevisiae) are sufficiently described in the literature. Promoters permitting a particularly high expression of a downstream sequence are for instance the T7 promoter (Studier et al., Methods in Enzymology 185 (1990), 60-89), lacUV5, trp, trp-lacUV5 (DeBoer et al., in Rodriguez and Chamberlin (Eds), Promoters, Structure and Function; Praeger, New York, (1982), 462-481; DeBoer et al., Proc. Natl. Acad. Sci. USA (1983), 21-25), Ip1, rac (Boros et al., Gene 42 (1986), 97-100). In some embodiments, inducible promoters are used for the synthesis of proteins. These promoters often lead to higher protein yields than do constitutive promoters. In some embodiments, in order to obtain an high yields of protein, a two-stage process is often used. First, the host cells are cultured under optimum conditions up to a relatively high cell density. In the second step, transcription is induced depending on the type of promoter used. In this regard, a tac promoter is particularly suitable which can be induced by lactose or IPTG (isopropyl-β-D-thiogalactopyranoside) (deBoer et al., Proc. Natl. Acad. Sci. USA 80 (1983), 21-25). Termination signals for transcription such as the SV40-poly-A site or the tk-poly-A site useful for applications in mammalian cells are also described in the literature. Suitable expression vectors are known in the art such as Okayama-Berg cDNA expression vector pcDV1 (Pharmacia), pCDM8, pRc/CMV, pcDNA1, pcDNA3 (In-vitrogene), pSPORT1 (GIBCO BRL)) or pCI (Promega).

The transformation of the host cell with a nucleic acid molecule or vector can be carried out by standard methods, as for instance described in Sambrook and Russell (2001), Molecular Cloning: A Laboratory Manual, CSH Press; Methods in Yeast Genetics, A Laboratory Course Manual, Cold Spring Harbor Laboratory Press (1990). In some embodiments, for example, calcium chloride transfection is commonly utilized for prokaryotic cells, whereas, e.g., calcium phosphate or DEAE-Dextran mediated transfection or electroporation may be used for other cellular hosts. In some embodiments, the host cell is cultured in nutrient media meeting the requirements of the particular host cell used, in particular in respect of the pH value, temperature, salt concentration, aeration, antibiotics, vitamins, trace elements etc. In some embodiments, the fusion protein can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromography and lectin chromatography. In some embodiments, the fusion protein may be purified applying an affinity chromatography with a substrate to which the binding portion of the fusion protein binds. Protein refolding steps can be used, as necessary, in completing the configuration of the protein. Finally, high performance liquid chromatography (HPLC) can be employed for final purification steps.

In some embodiments, a method for producing the fusion protein, as disclosed herein, comprising culturing the above-described host cells under conditions allowing the expression of said fusion protein and recovering said fusion protein from the culture is provided. Depending on whether the expressed protein is localized in the host cells or is secreted from the cell, the protein can be recovered from the cultured cells and/or from the supernatant of the medium.

In some embodiments, the fusion protein or non-protein construct may be a product of chemical synthetic procedures or produced by recombinant techniques from a prokaryotic or eukaryotic host (for example, by bacterial, yeast, higher plant, insect or mammalian cells in culture). Depending upon the host employed in a recombinant production procedure, the expressed fusion protein may be glycosylated or may be non-glycosylated. In some embodiments, the fusion protein may also include an initial methionine amino acid residue. In some embodiments, the protein may be further modified to contain additional chemical moieties not normally part of the protein. Those derivatized moieties may, e.g., improve the stability, solubility, the biological half-life or absorption of the protein. The moieties may also reduce or eliminate any undesirable side effects of the protein and the like. An overview for these moieties can be found, e.g., in Remington's Pharmaceutical Sciences (18th edition, Mack Publishing Co., Easton, Pa. (1990)).

Some embodiments relate to non-human transgenic organisms, i.e. multicellular organisms comprising a nucleic acid molecule encoding a fusion protein, as disclosed herein, or an expression cassette or vector as described above, e.g., stably integrated into its genome, at least in a subset of the cells of that organism, or to parts thereof such as tissues or organs. Where non-human organisms are used, the animal can be used as a model for studying glucose levels or other analyte levels in the organism. In some embodiments, tissue from a human can be harvested and the cells therein can be treated with a nucleic acid molecule encoding a fusion protein as disclosed herein (or an expression cassette or vector as described above), to stably integrate the nucleic acid into the genome. In some embodiments, this tissue can be implanted back into the human for the purposes of diagnoses or treatment.

Some embodiments also relate to a method for producing transgenic plants and animals, plant or animal tissue or plant or animal cells comprising the introduction of a nucleic acid molecule, expression cassette or vector, as disclosed herein, into a cell and, optionally, regenerating a transgenic plant or animal or plant or animal tissue therefrom. In particular, transgenic plants or animals expressing a fusion protein as described herein can be of use for investigating metabolic or transport processes of, e.g., organic compounds with a timely and spatial resolution that was not achievable previously. In some embodiments, harvestable parts and to propagation material of the transgenic organisms are prepared according to the invention which contain transgenic cells as described above. Harvestable parts can be in principle any useful part of an organism, for example, skin, organs, etc. In some embodiments, a skin graft comprising cells modified to produce the disclosed indicators could be used to detect analyte levels (e.g., glucose levels) in a patient and to diagnose and/or treat diseases (e.g., diabetes).

The invention also relates to a transgenic non-human animal comprising at least one nucleic acid molecule, expression cassette or vector, as disclosed herein, as described above. Some embodiments pertain to a method for the production of a transgenic non-human animal comprising introducing a nucleic acid molecule, expression cassette or vector of the invention into a germ cell, an embryonic cell, stem cell or an egg or a cell derived therefrom. Such transgenic animals expressing the fusion protein of the invention or any developmental stage thereof starting from the zygote may be used as model organisms where it is possible to determine the distribution of a certain compound in real time without disrupting tissue integrity. These model organisms may be particularly useful for testing. Production of transgenic embryos and screening of them can be performed, e.g., as described by A. L. Joyner Ed., Gene Targeting, A Practical Approach (1993), Oxford University Press. The DNA of the embryos can be analyzed using, e.g., Southern blots with an appropriate probe or based on PCR techniques.

A transgenic non-human animal in accordance with the invention may, e.g., be a transgenic mouse, rat, hamster, dog, monkey, rabbit, pig, frog, nematode such as *Caenorhabditis elegans*, fruitfly such as *Drosophilia melanogaster* or fish such as torpedo fish or zebrafish comprising a nucleic acid molecule, expression cassette or vector, as disclosed herein, e.g., stably integrated into its genome, or obtained by the method mentioned above. Such a transgenic non-human animal may comprise one or several copies of the same or different nucleic acid molecules, as disclosed herein. In some embodiments, the presence of a nucleic acid molecule, expression cassette or vector, as disclosed herein, in such a transgenic non-human animal leads to the expression of the fusion protein, as disclosed herein. The transgenic non-human animal has numerous utilities, including as a research model. Accordingly, in some embodiments, the mammal is a laboratory animal such as a mouse or rat.

For intracellular analyte measurements, the fusion protein, as disclosed herein, may be transferred into a cell by direct microinjection or by microinjection of RNA encoding the fusion protein and capable of expressing it in the cell. Apart from the way of introducing the fusion protein into the cell, this embodiment corresponds to the method for detecting an analyte in a cell described above, wherein the cells are genetically engineered with an nucleic acid molecule, expression construct or vector encoding and capable of expressing the fusion protein in the cell. Suitable techniques for introducing proteins or protein-expressing RNA into cells by way of microinjection are known to the person skilled in the art and are described in the literature. For instance, such introduction may be carried out by applying techniques as described in Celis J. E., Graessmann A., Loyter A. (1986), Microinjection and Organelle Transplantation Techniques, Academic Press, London; Celis J. E. (1994), Cell Biology: A Laboratory Handbook, Vol. 3, Academic Press, New York; and Cid-Arregui A. and Garcia-Carranca A. (eds) (1997), Microinjection and Transgenesis: Strategies and Protocols, Springer-Verlag, Berlin-Heidelberg-New York.

The use of microinjection for introducing the fusion protein, as disclosed herein, whether directly or indirectly in the form of an expressable mRNA, brings about the advantage of a reduced time required until results are obtained, as compared to transformation approaches. In particular, it usually takes only a few days until the introduced mRNA expresses the encoded fusion protein and subsequently fluorescence can be measured. When it is the fusion protein which is microinjected, then the results may be obtained even faster and fluorescence can be measured within minutes. Another advantage is that the level of expression of the introduced mRNA and the abundance of the introduced protein, respectively, can easily be modulated by the amount of the microinjected material. Since fluorescence is known to be a sensitive method, usually relatively small amounts of material may be required in order to achieve significant measurements of intracellular analyte concentration. On the other hand, the application of microinjection may be less favorable than transformation approaches if it is intended to observe analyte concentration in a given cell for a longer time period than for instance a few days. Also, if analyte concentration in cellular compartments other than the cytoplasm or the nucleus is intended to be measured, microinjection may not be feasible since direct microinjection into such other compartments is, at least at present, not possible.

Other methods of delivering genes, nucleic acids, DNA, RNA, proteins, or vectors into living cells include but are not limited to electroporation, viruses (transduction), lipofection, gene gun (biolistics), vesicle fusion, or chemical transformation. One type of viral vector is based on an adeno-associated virus (AAV). This defective parvovirus can infect many cell types (including non-dividing cells) and is non-pathogenic to humans. AAV can be produced in mammalian cells, including HEK 293T cells, COS cells, HeLa cells, KB cells, and other mammalian cell lines and in insect cells including Sf9, Sf21, and other insect cells using the baculovirus expression vector system (BEVS).

With the provision of the indicator compounds and fusion proteins disclosed herein, it is possible to directly observe the distribution and concentration of a certain analyte (e.g. a metabolite) in a single living cell. This allows the observation whether contacting a single cell expressing an appropriate fusion protein, as disclosed herein, with a candidate compound leads to a change in the concentration and/or distribution of the analyte in the cell, such a change being apparent from a change in the energy emission pattern that is emitted by the cell that expresses the fusion protein. In addition, the technology provided herein not only allows detecting whether there is a change in analyte concentration and/or distribution but it also allows quantifying such a change.

In some embodiments, in principle any kind of cell may be used for the present method that is amenable to optical detection and that can be transformed so as to express a heterologous protein. Thus, the cells may be single cells such as bacteria, yeasts, protozoa or cultured cells, e.g., of vertebrate, mammalian, human origin or plant cells. For certain applications, it may be useful to take pathogenetically affected cells such as tumor cells or cells infected by an infectious agent, e.g. a virus, wherein measurements may be conducted in comparison with corresponding healthy cells. Likewise, the cells may be part of a tissue, organ or organism. In some embodiments, the cells are immobilized which facilitates their observation (e.g., as a skin patch).

Furthermore, some embodiments relate to the use of a fusion protein, as disclosed herein, or the nucleic acid molecule, the expression cassette, the vector, the host cell or the control sensor, as disclosed herein, as described above, for preparing a diagnostic composition for diagnosing a condition which is correlated with a concentration of an analyte in cells, tissues or parts of a body. In some embodiments, the condition is a pathological condition correlated with an abnormal concentration of an analyte (e.g., diabetes and glucose).

In some embodiments, the detection of analytes using the techniques and compounds disclosed herein offer one or more of the following advantages (or others): high specificity toward glucose that does not chemically change glucose; high customizability with mutations to the luminescent protein and the glucose binding protein; low cost of manufacturing; the indicator compound may be synthesized as a whole; *E. coli* alone has approximately ~1200 transporters specifically evolved to transport various molecules, including metals, proteins, ions, small chemicals, etc.

It is understood that the protein sequences disclosed herein are to be interpreted as being in the N-terminal to C-terminal direction. Similarly, it is understood that the nucleic acid sequences disclosed herein are to be interpreted as being in the 5' to 3' direction.

Methods of Using

Some embodiments pertain to a method for detecting glucose in a diabetic patient. In embodiments, a sensor as disclosed herein is injected, surgically implanted, and/or partially inserted (with an inserter) into the body of the patient. In several embodiments, the sensor is inserted to a depth so that the indicator compound (e.g., in the device) is at a depth under the surface of the skin of equal to or at least about: 1 mm, 2 mm, 3 mm, 4 mm, or ranges including and/or spanning the aforementioned values. In some embodiments, the sensor is interrogated with a light emitting device. In some embodiments, the light emitting device is brought into proximity to the sensor. In some embodiments, the light emitting device is provided within the sensor.

In some embodiments, an indicator compound is administered to the patient. In some embodiments, the indicator compound is a fusion protein. In some embodiments, the fusion protein comprises a luminescent protein and/or a one or more luminescing fragments of a luminescent protein. In some embodiments, the fusion protein further comprises a sugar binding protein and/or a sugar binding portion of a sugar binding protein. In some embodiments, the sugar binding protein and/or sugar binding portion of the sugar binding protein is configured to bind glucose. In some embodiments, the indicator compound undergoes a conformational change from a first conformation to a second conformation when glucose binds to indicator compound. In some embodiments, the indicator compound is exposed to a light having energy that is sufficient to induce luminescence of the indicator compound when glucose is bound by the sugar binding protein and/or sugar binding portion of the sugar binding protein.

In some embodiments, the method comprises illuminating the indicator compound with light and detecting an emission of generated light at a maximum wavelength. In some embodiments, the $\lambda_{max}$ of the light absorbed by the indicator compound is equal to or at least about: 300 nm, 350 nm, 400 nm, 450 nm, 500 nm, 550 nm, 600 nm, 650 nm, 700 nm, 750 nm, or ranges including and/or spanning the aforementioned values. In some embodiments, the $\lambda_{max}$ of the light emitted by the indicator compound is equal to or at least about: 300 nm, 350 nm, 400 nm, 450 nm, 500 nm, 550 nm, 600 nm, 650 nm, 700 nm, 750 nm, or ranges including and/or spanning the aforementioned values.

In some embodiments, as disclosed elsewhere herein, multiple indicator compounds may simultaneously be used to detect different analytes. In several embodiments, where multiple indicator compounds are used, the $\lambda_{max}$ of the light absorbed by the indicator compounds is independently equal to or at least about: 300 nm, 350 nm, 400 nm, 450 nm, 500 nm, 550 nm, 600 nm, 650 nm, 700 nm, 750 nm, or ranges including and/or spanning the aforementioned values. In some embodiments, the $\lambda_{max}$ of the light emitted by the indicator compounds is independently equal to or at least about: 300 nm, 350 nm, 400 nm, 450 nm, 500 nm, 550 nm, 600 nm, 650 nm, 700 nm, 750 nm, or ranges including and/or spanning the aforementioned values. In some embodiments, multiple indicator compounds may simultaneously be used to the same analyte (thereby providing internal standards to ensure accurate measurement). In some embodiments, where more than one indicator compound is used, the indicator compounds are selected to have $\lambda_{max}$ values for light absorbed that are different by equal to or at least about: 10 nm, 20 nm, 30 nm, 40 nm, 50 nm, 60 nm, 70 nm, 100 nm, 200 nm, 300 nm, or ranges including and/or spanning the aforementioned values. In some embodiments, where more than one indicator compound is used, the indicator compounds are selected to have $\lambda_{max}$ values for light emitted that are different by equal to or at least about: 10 nm, 20 nm, 30 nm, 40 nm, 50 nm, 60 nm, 70 nm, 100 nm, 200 nm, 300 nm, or ranges including and/or spanning the aforementioned values. Having different emission and absorption wavelengths helps avoid overlapping signals and errors in measurements.

Some embodiments disclosed herein related to selecting a subject or patient in need. In some embodiments, a patient is selected who has a disease. In some embodiments, a patient is selected who has diabetes mellitus, such as type 1 diabetes or type 2 diabetes. In some embodiments, a patient is selected who is a risk of contracting diabetes. In some embodiments, a patient is selected who is in need of treatment for diabetes. In some embodiments, a patient is selected who is need of diagnosing diabetes. In some embodiments, a patient is selected who is in need of managing diabetes, including but not limited to measuring blood glucose levels. In some embodiments, a patient is selected who may have any combination of the aforementioned selection criteria.

In some embodiments, a method for detecting an analyte is provided. In some embodiments, the method for detecting an analyte comprises contacting a sample with an indicator compound. In some embodiments, the indicator compound is a fusion protein. In some embodiments, the method comprises supplying the fusion protein with energy suitable for exciting energy emission by the signaling domain of the indicator compound. In some embodiments, the method comprises measuring the energy emission. In some embodiments, the analyte is in the body of a patient. In some embodiments, a device comprising the indicator compound is introduced to the body of the patient.

Some embodiments provide a method for detecting or quantifying an analyte in mammalian skin fluid. In some embodiments, the method comprises injecting or embedding a sensor for detecting or quantifying an analyte in the epidermis or interior skin. In some embodiments, the method includes bringing the measuring device in proximity to the sensor. In some embodiments, a reading of the measuring device is obtained using optical means. In some embodiments, the measured value obtained is associated with the concentration of the analyte.

In some embodiments, the fusion protein is fixed to a solid support. In some embodiments, binding affinity of the binding portion of the fusion protein is in a range that allows reversible analyte binding. In some embodiments, such fixed fusion proteins to construct measuring devices where said support containing the fusion protein is assembled with means for excitation and detection of energy emission. Such devices may be useful as sensors for detecting compounds in fluid samples, for example, for measuring blood sugar.

In some embodiments, a multitude of different fusion proteins being specific for different analytes and/or having different measuring ranges are assembled on one array. In some embodiments, upon contacting a sample to such an array, the array may for example be scanned with a combined excitation/detection means. Such a system may be of particular utility in automated or semi-automated high throughput screening of samples.

In some embodiments, the method comprises contacting a sample corresponding with a control sensor, whereby said control sensor corresponds to the fusion protein used for analysis with the exception that the binding portion is modified and therefore incapable of binding the analyte. In some embodiments, the method comprises supplying the control sensor with the same energy as the analyte binding indicator compound. In some embodiments, the method comprises measuring the energy emission of the control sensor. In some embodiments, the method comprises calibrating the energy emission measurement of the control sensor with the active sensor. In some embodiments, the method comprises calibration of the measurements of using the control sensor. In some embodiments, the term "control sensor" refers to a protein which corresponds to the active binding fusion protein except for a modification of the binding portion which renders it incapable of binding the respective analyte. Thus, apart from this, the control sensor has the same functional properties as the corresponding fusion protein with respect to the excitation and emission spectrum. In some embodiments, other characteristics are also identical such as solubility, isoelectric point, molecular weight, pH sensitivity, sensitivity to other factors such as ionic environment etc.

It is contemplated that parallel measurements using a control sensor may greatly refine the measurements conducted with the fusion protein of the invention because it excludes influences apart from analyte concentration that may affect energy emission of the fusion protein. Moreover, the overall protein structure of the fusion protein may be affected by other factors than analyte concentration such as ionic conditions.

In some embodiments, the method comprises detecting an analyte in a cell. In some embodiments, the method comprises supplying a cell which is genetically engineered with the nucleic acid molecule, the expression cassette or the vector of the invention and expresses the fusion protein of the indicator compound. In some embodiments, the method comprises (b) measuring the energy emission. In some embodiments, the method is performed on human or animal cells, this method is only applied ex vivo, i.e. outside the human or animal body. For intracellular analyte measurements, the fusion protein of the invention may be transferred into a cell by direct microinjection or by microinjection of RNA encoding the fusion protein and capable of expressing it in the cell. Apart from the way of introducing the fusion protein into the cell, this embodiment corresponds to the method for detecting an analyte in a cell described above, wherein the cells are genetically engineered with an nucleic acid molecule, expression construct or vector encoding and capable of expressing the fusion protein in the cell.

The following references are incorporated by reference in their entireties: Mita, M. et. al. (2019). Green Fluorescent Protein-Based Glucose Indicators Report Glucose Dynamics in Living Cells. Anal. Chem. (91) 4821-4830; Method of glucose or galactose detection with glucose/galactose binding protein. CA2336985C; Fusion proteins useful for detecting analytes. US20070136825A1; System and method for detecting bioanalytes and method for producing a bioanalyte sensor. US20050118726A1; Proteins, sensors, and methods of characterizing analytes using the same. U.S. Pat. No. 7,718,353B2; Compositions and methods for analyte detection. U.S. Pat. No. 6,485,703B1; Substrates and screening methods for transport proteins. US20090221442A1; In vivo biosensor apparatus and method of use. CA2352571C; Hu, H.; Wei, Y.; Wang, D.; Su, N.; Chen, X.; Zhao, Y.; Liu, G.; Yang, Y. RSC Adv. 2018, 8 (5), 2485-2489; U.S. Pat. Nos. 6,400,974; 6,794,195; 7,800,078; 7,713,745; 7,375,347; 9,717,413; 7,060,503; 7,157,723; 7,190,445; 7,227,156; 7,939,332; 7,405,387; 7,851,225; 7,822,450; 8,502,167; 8,143,068; 9,693,714; 9,681,824; 9,498,156; 9,717,413; 10,111,588 9,931,068; 9,414,775; 9,814,389; 9,867,540; 9,778,190; 9,743,869; 10,119,911; 10,662,333; and U.S. Application Publication No. 2014/0088383.

EXAMPLES

Some aspects of the embodiments discussed above are disclosed in further detail in the following examples, which are not in any way intended to limit the scope of the present disclosure. Those in the art will appreciate that many other embodiments also fall within the scope of the invention, as it is described herein above and in the claims.

Example 1. Genetically Modified Skin Graft for Use as a Glucose Sensor

A patient is selected as having diabetes mellitus (diabetes), or as being at risk of having diabetes, previously having diabetes, or not having diabetes. There is a need for the patient to monitor his or her blood glucose levels. A skin sample (e.g. a split-thickness skin graft) is taken from the patient and maintained in growth medium. The skin sample is genetically modified, such as by microinjection or AAV, to express one or more of the indicator compounds described herein comprising a glucose binding protein or binding portion thereof. The keratinocytes, melanocytes, Langerhans cells, Merkel cells, immune cells, macrophages, epithelial cells, or red blood cells that make up the skin sample are genetically modified. After successful modification, the skin sample is grafted back onto the patient, either at the original location or a new location, such as a region on the body that is easily observable. The modified skin region now luminesces or fluoresces according to the glucose in the microenvironment interstitial fluid, which correlates to blood glucose levels. The patient is able to use this signal to determine current blood glucose levels without the need for invasive blood sampling methods. Detection of the signal may be done with a device that is specifically calibrated for the patient.

Example 2: Fabrication of Fiber Optic Sensor

A fiber optic sensor as disclosed in FIG. 10C was prepared. The optical part of the fiber optic fluorimeter was fabricated on a microbench using standard components. This assembling apparatus comprises a red LED, a dichroic beam splitter, a filter and a detector diode as a light source. Briefly, the fluorimeter comprises a light emitting diode that emits an excitation light beam that passes through a condenser containing an excitation filter and a beam splitter. The excitation beam is enters the optical fiber (e.g., the waveguide). When the fluorometer is in use, when querying the sensor placed percutaneously at the skin end with the axis of the skin sensor aligned so that the excitation light beam enters the sensor, the sensor emits light after excitation. Some of the optical signal obtained enters this optical fiber and is thereby transmitted into the fluorimeter. This fluorimeter also contains a reference detector diode from which a reference measurement of the excitation light emitted from the LED is obtained. These two integrated signals correspond to the background-corrected fluorescence signal and the background-corrected excitation light level (LED intensity). This fluorimeter is battery operated (typical power consumption is 150 mA at 9 v) and can be conveniently constructed with pen shapes and dimensions.

Example 3. Fiber Optic Glucose Sensor

A glucose sensor as disclosed in FIG. 10C is implanted onto a diabetic patient. The sensor comprises a waveguide having the an indicator compound as disclosed in FIG. 2C embedded within the matrix material. The patient interrogates the sensor at various times throughout the day to determine his blood glucose level. The patient is able to monitor and control his blood glucose level by taking periodic readings using the sensor and a light emitting device that interrogates the sensor. The patient is better able to control his blood glucose than he previously had been able to using finger prick blood glucose measurements.

It is to be understood that the embodiments of the invention herein described are merely illustrative of the application of the principles of the invention. Reference herein to details of the illustrated embodiments is not intended to limit the scope of the claims, which themselves recite those features regarded as essential to the invention. The drawings are for the purpose of illustrating embodiments of the invention only, and not for the purpose of limiting it.

The invention is generally disclosed herein using affirmative language to describe the numerous embodiments. The invention also includes embodiments in which subject matter is excluded, in full or in part, such as substances or materials, method steps and conditions, protocols, or procedures.

In at least some of the previously described embodiments, one or more elements used in an embodiment can interchangeably be used in another embodiment unless such a replacement is not technically feasible. It will be appreciated by those skilled in the art that various other omissions, additions and modifications may be made to the methods and structures described above without departing from the scope of the claimed subject matter. All such modifications and changes are intended to fall within the scope of the subject matter, as defined by the appended claims.

With respect to the use of substantially any plural and/or singular terms herein, those having skill in the art can translate from the plural to the singular and/or from the singular to the plural as is appropriate to the context and/or application. The various singular/plural permutations may be expressly set forth herein for sake of clarity.

It will be understood by those within the art that, in general, terms used herein, and especially in the appended claims (e.g., bodies of the appended claims) are generally intended as "open" terms (e.g., the term "including" should be interpreted as "including but not limited to," the term "having" should be interpreted as "having at least," the term "includes" should be interpreted as "includes but is not limited to," etc.). It will be further understood by those within the art that if a specific number of an introduced claim recitation is intended, such an intent will be explicitly recited in the claim, and in the absence of such recitation no such intent is present. For example, as an aid to understanding, the following appended claims may contain usage of the introductory phrases "at least one" and "one or more" to introduce claim recitations. However, the use of such phrases should not be construed to imply that the introduction of a claim recitation by the indefinite articles "a" or "an" limits any particular claim containing such introduced claim recitation to embodiments containing only one such recitation, even when the same claim includes the introductory phrases "one or more" or "at least one" and indefinite articles such as "a" or "an" (e.g., "a" and/or "an" should be interpreted to mean "at least one" or "one or more"); the same holds true for the use of definite articles used to introduce claim recitations. In addition, even if a specific number of an introduced claim recitation is explicitly recited, those skilled in the art will recognize that such recitation should be interpreted to mean at least the recited number (e.g., the bare recitation of "two recitations," without other modifiers, means at least two recitations, or two or more recitations). Furthermore, in those instances where a convention analogous to "at least one of A, B, and C, etc." is used, in general such a construction is intended in the sense one having skill in the art would understand the convention (e.g., "a system having at least one of A, B, and C" would include but not be limited to systems that have A alone, B alone, C alone, A and B together, A and C together, B and C together, and/or A, B, and C together, etc.). In those instances where a convention analogous to "at least one of A, B, or C, etc." is used, in general such a construction is intended in the sense one having skill in the art would understand the convention (e.g., "a system having at least one of A, B, or C" would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase "A or B" will be understood to include the possibilities of "A" or "B" or "A and B."

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, such as in terms of providing a written description, all ranges disclosed herein also encompass any and all possible sub-ranges and combinations of sub-ranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like include the number recited and refer to ranges which can be subsequently broken down into sub-ranges as discussed above. Finally, as will be understood by one skilled in the art, a range includes each individual member. Thus, for example, a group having 1-3 articles refers to groups having 1, 2, or 3 articles. Similarly, a group having 1-5 articles refers to groups having 1, 2, 3, 4, or 5 articles, and so forth.

While various aspects and embodiments have been disclosed herein, other aspects and embodiments will be apparent to those skilled in the art. The various aspects and embodiments disclosed herein are for purposes of illustration and are not intended to be limiting, with the true scope and spirit being indicated by the following claims.

All references cited herein, including but not limited to published and unpublished applications, patents, and literature references, are incorporated herein by reference in their entirety and are hereby made a part of this specification. To the extent publications and patents or patent applications incorporated by reference contradict the disclosure contained in the specification, the specification is intended to supersede and/or take precedence over any such contradictory material.

SEQUENCE LISTING (1746 sequences)

SEQ ID NO: 1 - protein, 238 aa, Aequorea victoria
VSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 2 - protein, 332 aa, Escherichia coli
MNKKVLTLSAVMASMLFGAAAHAADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSKK

SEQ ID NO: 3 - protein, 581 aa, Escherichia coli
MRFGLWRYPLMATPGCWQNPRSPCSVVNSTCTVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 4 - protein, 581 aa, Escherichia coli
MRFGLWRYPLMATPGCWQNPRSPCSVVNSTCTVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDNYMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 5 - protein, 581 aa, Escherichia coli
MRFGLWRYPLMATPGCWQNPRSPCSVVNSTCTVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDYYMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 6 - protein, 581 aa, Escherichia coli
MRFGLWRYPLMATPGCWQNPRSPCSVVNSTCTVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDNLMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 7 - protein, 544 aa, Escherichia coli
VSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNADTRIGVTIYKYDDNYMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 8 - protein, 544 aa, Escherichia coli
VSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNADTRIGVTIYKYDDYYMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 9 - protein, 544 aa, Escherichia coli
VSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNADTRIGVTIYKYDDNLMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 10 - protein, 550 aa, Escherichia coli
MVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 11 - protein, 550 aa, Escherichia coli
MVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDNYMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 12 - protein, 550 aa, Escherichia coli
MVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDYYMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 13 - protein, 550 aa, Escherichia coli
MVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEFGLLGVDTSIGVTIYKYDDNLMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSEVDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 14 - protein, 246 aa, Aequorea victoria
YNSDNVYIMADKQKNGIKAYFKIRHNVEDGSVQLADHYQQNTPIGDGPVLLPDNHYLSFQSVLSKDPNEKRDHMVLLEFVTAAGITLGMDELYNVDGGSGGTGSKGEELFTGVVPILVELDGDVNGHKFSVSGEGEGDATYGKLTLKLICTTGKLPVPWPTLVTTLGYGLKCFARYPDHMKQHDFFKSAMPEGYVQERTIFFKDDGNYKTRAEVKFEGDTLVNRIELKGIGFKEDGNILGHKLEYN

SEQ ID NO: 15 - protein, 310 aa, Escherichia coli
MADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYVGVDKDNLAEFSKK

SEQ ID NO: 16 - protein, 556 aa, Escherichia coli
MADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPYNSDNVYIMADKQKNGIKAYFKIRHNVEDGSVQLADHYQQNTPIGDGPVLLPDNHYLSFQSVLSKDPNEKRDHMVLLEFVTAAGITLGMDELYNVDGGSGGTGSKGEELFTGVVPILVELDGDVNGHKFSVSGEGEGDATYGKLTLKLICTTGKLPVPWPTLVTTLGYGLKCFARYPDHMKQHDFFKSAMPEGYVQERTIFFKDDGNYKTRAEVKFEGDTLVNRIELKGIGFKEDGNILGHKLEYNYVGVDKDNLAEFSKK

SEQ ID NO: 17 - protein, 549 aa, Escherichia coli
MADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLNDANNQAKATFDLAKNLADGKGAADGTNWKIDNKVVRVPDNVYIMADKQKNGIKAYFKIRHNVEDGSVQLADHYQQNTPIGDGPVLLPDNHYLSFQSVLSKDPNEKRDHMVLLEFVTAAGITLGMDELYNVDGGSGGTGSKGEELFTGVVPILVELDGDVNGHKFSVSGEGEGDATYGKLTLKLICTTGKLPVPWPTLVTTLGYGLKCFARYPDHMKQHDFFKSAMPEGYVQERTIFFKDDGNYKTRAEVKFEGDTLVNRIELKGIGFKEDGNILGHKYVGVDKDNLAEFSKK

SEQ ID NO: 18 - protein, 549 aa, Escherichia coli
MADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDALPEALALVKSGALAGTVLSDANNQAKATFDLAKNLADGKGAADGTNWKIDNKVVRVPDNVYIMADKQKNGIKAYFKIRHNVEDGSVQLADHYQQNTPIGDGPVLLPDNHYLSFQSVLSKDPNEKRDHMVLLEFVTAAGITLGMDELYNVDGGSGGTGSKGEELFTGVVPILVELDGDVNGHKFSVSGEGEGDATYGKLTLKLICTTGKLPVPWPTLVTTLGYGLKCFARYPDHMKQHDFFKSAMPEGYVQERTIFFKDDGNYKTRAEVKFEGDTLVNRIELKGIGFKEDGNILGHKYVGVDKDNLAEFSKK

SEQ ID NO: 19 - protein, 549 aa, Escherichia coli
MADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDAMAMGAVEALKAHNKSSIPVFGVDASPEALALVKSGALAGTVLNDANNQAKATFDLAKNLADGKGAADGTNWKIDNKVVRVPDNVYIMADKQKNGIKAYFKIRHNVEDGSVQLADHYQQNTPIGDGPVLLPDNHYLSFQSVLSKDPNEKRDHMVLLEFVTAAGITLGMDELYNVDGGSGGTGSKGEELFTGVVPILVELDGDVNGHKFSVSGEGEGDATYGKLTLKLICTTGKLPVPWPTLVTTLGYGLKCFARYPDHMKQHDFFKSAMPEGYVQERTIFFKDDGNYKTRAEVKFEGDTLVNRIELKGIGFKEDGNILGHKYVGVDKDNLAEFSKK

SEQ ID NO: 20 - protein, 549 aa, Escherichia coli
MADTRIGVTIYKYDDNFMSVVRKAIEQDAKAAPDVQLLMNDSQNDQSKQNDQIDVLLAKGVKALAINLVDPAAAGTVIEKARGQNVPVVFFNKEPSRKALDSYDKAYYVGTDSKESGIIQGDLIAKHWAANQGWDLNKDGQIQFVLLKGEPGHPDAEARTTYVIKELNDKGIKTEQLQLDTAMWDTAQAKDKMDAWLSGPNANKIEVVIANNDRMAMGAVEALKAHNKSSIPVFGVDALPEALALVKSGALAGTVLNDANNQAKATFDLAKNLADGKGAADGTNWKIDNKVVRVPDNVYIMADKQKNGIKAYFKIRHNVEDGSVQLADHYQQNTPIGDGPVLLPDNHYLSFQSVLSKDPNEKRDHMVLLEFVTAAGITLGMDELYNVDGGSGGTGSKGEELFTGVVPILVELDGDVNGHKFSVSGEGEGDATYGKLTLKLICTTGKLPVPWPTLVTTLGYGLKCFARYPDHMKQHDFFKSAMPEGYVQERTIFFKDDGNYKTRAEVKFEGDTLVNRIELKGIGFKEDGNILGHKYVGVDKDNLAEFSKK

SEQ ID NO: 21 - DNA, 1746 bp, Escherichia coli
atgcggttcgggctctggaggtacccactgatggcaacgccgggctgctggcagaaccccagatcgccatgttctgtggtaaactcaacatgcacagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagttcggccttctaggcgttgatactagcattggtgtaacaatctataagtacgacgataactttatgtctgtagtgcgcaaggctattgagcaagatgcgaaagccgcgccagatgttcagctgctgatgaatgattctcagaatgaccagtccaagcagaacgatcagatcgacgtattgctggccaagggggtgaaggcactggccatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactcaaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttatgttggcgtagataaagacaacctggctgaattcagcgaagtcgacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtag

SEQ ID NO: 22 - DNA, 1746 bp, Escherichia coli
atgcggttcgggctctggaggtacccactgatggcaacgccgggctgctggcagaaccccagatcgccatgttctgtggtaaactcaacatgcacagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagttcggccttctaggcgttgatactagcattggtgtaacaatctataagtacgacgataactatatgtctgtagtgcgcaaggctattgagcaagatgcgaaagccgcgccagatgttcagctgctgatgaatgattctcagaatgaccagtccaagcagaacgatcagatcgacgtattgctggccaagggggtgaaggcactggccatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactcaaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttatgttggcgtagataaagacaacctggctgaattcagcgaagtcgacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtag

SEQ ID NO: 23 - DNA, 1746 bp, Escherichia coli
atgcggttcgggctctggaggtacccactgatggcaacgccgggctgctggcagaaccccagatcgccatgttctgtggtaaactcaacatgcacagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagttcggccttctaggcgttgatactagcattggtgtaacaatctataagtacgacgattactatatgtctgtagtgcgcaaggctattgagcaagatgcgaaagccgcgccagatgttcagctgctgatgaatgattctcagaatgaccagtccaagcagaacgatcagatcgacgtattgctggccaagggggtgaaggcactggccatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactcaaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttatgttggcgtagataaagacaacctggctgaattcagcgaagtcgacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtag

SEQ ID NO: 24 - DNA, 1746 bp, Escherichia coli
atgcggttcgggctctggaggtacccactgatggcaacgccgggctgctggcagaaccccagatcgccatgttctgtggtaaactcaacatgcacagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagttcggccttctaggcgttgatactagcattggtgtaacaatctataagtacgacgataacttaatgtctgtagtgcgcaaggctattgagcaagatgcgaaagccgcgccagatgttcagctgctgatgaatgattctcagaatgaccagtccaagcagaacgatcagatcgacgtattgctggccaagggggtgaaggcactggccatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactcaaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttatgttggcgtagataaagacaacctggctgaattcagcgaagtcgacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtag

SEQ ID NO: 25 - DNA, 1653 bp, Escherichia coli
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtttggtctcctgggagttgatactagcattggtgtaacaatctataagtacgacgataactttatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttatgttggcgtagataaagacaacctggctgagttcagcgaggtggatagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 26 - DNA, 1653 bp, Escherichia coli
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtttggtctcctgggagttgatactagcattggtgtaacaatctataagtacgacgattattatatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttatgttggcgtagataaagacaacctggctgagttcagcgaggtggatagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 27 - DNA, 1653 bp, Escherichia coli; identical to SEQ ID NO: 26

SEQ ID NO: 28 - DNA, 1653 bp, Escherichia coli
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgatgtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtttggtctcctgggagttgatactagcattggtgtaacaatctataagtacgacgataacttgatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttatgttggcgtagataaagacaacctggctgagttcagcgaggtggatagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 29 - DNA, 1671 bp, Escherichia coli
atggctgatactcgcattggtgtaacaatctataagtatgatgataactttatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtaccttacaacagcgacaacgtctatatcatggccgacaagcagaagaacggcatcaaggcctacttcaagatccgccacaacgtcgaggacggcagcgtgcagctcgccgaccactaccagcagaacacccccatcggcgacggccccgtgctgctgcccgacaaccactacctgagcttccagtccgtcctgagcaaagaccccaacgagaagcgcgatcacatggtcctgctggagttcgtgaccgccgccgggatcactctcggcatggacgagctgtacaacgtggatggcggtagcggtggcaccggcagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctcggctacggcctgaagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcggcttcaaggaggacggcaacatcctggggcacaagctggagtacaactatgttggcgtagataaagacaacctggctgaattcagcaagaaataa

SEQ ID NO: 30 - DNA, 1650 bp, Escherichia coli
atggctgatactcgcattggtgtaacaatctataagtatgatgataactttatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtacctgacaacgtctatatcatggccgacaagcagaagaacggcatcaaggcctacttcaagatccgccacaacgtcgaggacggcagcgtgcagctcgccgaccactaccagcagaacacccccatcggcgacggccccgtgctgctgcccgacaaccactacctgagcttccagtccgtcctgagcaaagaccccaacgagaagcgcgatcacatggtcctgctggagttcgtgaccgccgccgggatcactctcggcatggacgagctgtacaacgtggatggcggtagcggtggcaccggcagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctcggctacggcctgaagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcggcttcaaggaggacggcaacatcctggggcacaagtatgttggcgtagataaagacaacctggctgaattcagcaagaaataa

SEQ ID NO: 31 - DNA, 1650 bp, Escherichia coli
atggctgatactcgcattggtgtaacaatctataagtatgatgataactttatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgctgccagaagcgctggcgctggtgaaatccggtgcactggcgggcaccgtactgagcgatgctaacaaccaggcgaaagcgacctttgatctggcgaaaaacctggccgatggtaaaggtgcggctgatggcaccaactggaaaatcgacaacaaagtggtccgcgtacctgacaacgtctatatcatggccgacaagcagaagaacggcatcaaggcctacttcaagatccgccacaacgtcgaggacggcagcgtgcagctcgccgaccactaccagcagaacacccccatcggcgacggccccgtgctgctgcccgacaaccactacctgagcttccagtccgtcctgagcaaagaccccaacgagaagcgcgatcacatggtcctgctggagttcgtgaccgccgccgggatcactctcggcatggacgagctgtacaacgtggatggcggtagcggtggcaccggcagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctcggctacggcctgaagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcggcttcaaggaggacggcaacatcctggggcacaagtatgttggcgtagataaagacaacctggctgaattcagcaagaaataa

SEQ ID NO: 32 - DNA, 1650 bp, Escherichia coli
atggctgatactcgcattggtgtaacaatctataagtatgatgataactttatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatgcgatggcaatgggcgcggttgaagcgctgaaagcacacaacaagtccagcattccggtgtttggcgtcgatgcgtctccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtacctgacaacgtctatatcatggccgacaagcagaagaacggcatcaaggcctacttcaagatccgccacaacgtcgaggacggcagcgtgcagctcgccgaccactaccagcagaacacccccatcggcgacggccccgtgctgctgcccgacaaccactacctgagcttccagtccgtcctgagcaaagaccccaacgagaagcgcgatcacatggtcctgctggagttcgtgaccgccgccgggatcactctcggcatggacgagctgtacaacgtggatggcggtagcggtggcaccggcagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctcggctacggcctgaagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcggcttcaaggaggacggcaacatcctggggcacaagtatgttggcgtagataaagacaacctggctgaattcagcaagaaataa

SEQ ID NO: 33 - DNA, 1650 bp, Escherichia coli
atggctgatactcgcattggtgtaacaatctataagtatgatgataactttatgtctgtagtgcgcaaggctattgagcaagatgcgaaagccgcgccagatgttcagctgctgatgaatgattctcagaatgaccagtccaagcagaacgatcagatcgacgtattgctggcgaaaggggtgaaggcactggcaatcaacctggttgacccggcagctgcgggtacggtgattgagaaagcgcgtgggcaaaacgtgccggtggttttcttcaacaaagaaccgtctcgtaaggcgctggatagctacgacaaagcctactacgttggcactgactccaaagagtccggcattattcaaggcgatttgattgctaaacactgggcggcgaatcagggttgggatctgaacaaagacggtcagattcagttcgtactgctgaaaggtgaaccgggccatccggatgcagaagcacgtaccacttacgtgattaaagaattgaacgataaaggcatcaaaactgaacagttacagttagataccgcaatgtgggacaccgctcaggcgaaagataagatggacgcctggctgtctggcccgaacgccaacaaaatcgaagtggttatcgccaacaacgatcggatggcaatgggcgcggttgaagcgctgaaagcacacaacaagtccagcattccggtgtttggcgtcgatgcgctgccagaagcgctggcgctggtgaaatccggtgcactggcgggcaccgtactgaacgatgctaacaaccaggcgaaagcgacctttgatctggcgaaaaacctggccgatggtaaaggtgcggctgatggcaccaactggaaaatcgacaacaaagtggtccgcgtacctgacaacgtctatatcatggccgacaagcagaagaacggcatcaaggcctacttcaagatccgccacaacgtcgaggacggcagcgtgcagctcgccgaccactaccagcagaacacccccatcggcgacggccccgtgctgctgcccgacaaccactacctgagcttccagtccgtcctgagcaaagaccccaacgagaagcgcgatcacatggtcctgctggagttcgtgaccgccgccgggatcactctcggcatggacgagctgtacaacgtggatggcggtagcggtggcaccggcagcaagggcgaggagctgttcaccggggtggtgcccatcctggtcgagctggacggcgacgtaaacggccacaagttcagcgtgtccggcgagggcgagggcgatgccacctacggcaagctgaccctgaagctgatctgcaccaccggcaagctgcccgtgccctggcccaccctcgtgaccaccctcggctacggcctgaagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcggcttcaaggaggacggcaacatcctggggcacaagtatgttggcgtagataaagacaacctggctgaattcagcaagaaataa

SEQ ID NO: 34 - protein, 239 aa, Aequorea victoria
MVSKGEELFTGVVPILVELDGDVNGHRFSVSGEGEGDATYGKLTLKLICTTGKLPVPWPTLVTTLQFGVLCFARYPDHMKQHDFFKSAMPEGYVQERTIFFKDDGNYKTRAEVKFEGDTLVNRIELKGIDFKEDGNILGHKLEYNGISSNVYITADKQKNGIKAHFKIRHNIEDGGVQLADHYQQNTPIGDGPVLLPDNHYLSVQSKLSKDPNEKRDHMVLLESVTAAGITLGMDELYK

SEQ ID NO: 35 - protein, 238 aa, Aequorea victoria
MSKGEELFTGVVPILVELDGDVNGHKFSVSGEGEGDATYGKLTLKFICTTGKLPVPWPTLVTTLSHGVQCFSRYPDHMKQHDFFKSAMPEGYVQERTIFFKDDGNYKTRAEVKFEGDTLVNRIELKGIDFKEDGNILGHKLEYNFNSHNIYIMADKQKNGIKVNFKIRHNIEDGSVQLADHYQQNTPIGDGPVLLPDNHYLSTQSALSKDPNEKRDHMVLLEFRTAAGITHGMDELYK

SEQ ID NO: 36 - protein, 239 aa, Aequorea victoria
MVSKGEELFTGVVPILVELDGDVNGHKFSVSGEGEGDATYGKLTLKFICTTGKLPVPWPTLVTTLTHGVQCFSRYPDHMKQHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 37 - protein, 239 aa, Aequorea victoria
MVSKGEELFTGVVPILVELDGDVNGHKFSVRGEGEGDATNGKLTLKFICTTGKLPVPWPTLVTTLSHGVQCFARYPDHMKQHDFFKSAMPEGYVQERTIFFKDDGTYKTRAEVKFEGDTLVNRIELKGVDFKEDGNILGHKLEYNFNSHNIYIMAVKQKNGIKVNFKIRHNVEDGSVQLADHYQQNTPIGDGPVLLPDSHYLSTQSVLSKDPNEKRDHMVLLEFRTAAGITLGMDELYK

SEQ ID NO: 38 - protein, 239 aa, Aequorea victoria
MVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 39 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAISDNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 40 - protein, 239 aa, Aequorea victoria
MVSKGEELFGGIVPILVELEGDVNGHKFSVSGEGEGDATYGKLTLKFICTTGKLPVPWPTLVTTLTWGVQCFSRYPDHMKQHDFFKSVMPEGYVQERTIFFKDDGNYKTRAEVKFEGDTLVNRIELKGIDFKEDGNILGHKLEYNYISHNVYITADKQKNGIKANFKARHNITDGSVQLADHYQQNTPIGDGPVILPDNHYLSTQSALSKDPNEKRDHMVLLEFVTAAGITHGMDELYK

SEQ ID NO: 41 - protein, 239 aa, Aequorea victoria
MVSKGEELFTGVVPILVELDGDVNGHKFSVSGEGEGDATYGKLTLKFICTTGKLPVPWPTLVTTLTWGLQCFARYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 42 - protein, 239 aa, Aequorea victoria
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 43 - protein, 239 aa, Aequorea victoria
MVSKGEELFTGVVPILVELDGDVNGHKFSVSGEGEGDATYGKLTLKFICTTGKLPVPWPTLVTTLTYGVQCFARYPDHMKQHDFFKSAMPEGYVQERTIFFKDDGNYKTRAEVKFEGDTLVNRIELKGIDFKEDGNILGHKLEYNYNSHKVYITADKQKNGIKVNFKTRHNIEDGSVQLADHYQQNTPIGDGPVLLPDNHYLSTQSALSKDPNEKRDHMVLLEFVTAAGITLGMDELYK

SEQ ID NO: 44 - protein, 238 aa, Aequorea victoria
MSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYK

SEQ ID NO: 45 - protein, 239 aa, Aequorea victoria
MVSKGEELFTGVVPILVELDGDVNGHKFSVSGEGEGDATYGKLTLKFICTTGKLPVPWPTLVTTFSYGVMVFARYPDHMKQHDFFKSAMPEGYVQERTIFFKDDGNYKTRAEVKFEGDTLVNRIELKGIDFKEDGNILGHKLEYNFNSHNVYIMADKQKNGIKANFKIRHNIEDGGVQLADHYQQNTPIGDGPVLLPDNHYLSIQSALSKDPNEKRDHMVLLEFVTAAGITLGMDELYK

SEQ ID NO: 46 - protein, 239 aa, Aequorea victoria
MVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 47 - protein, 238 aa, Aequorea victoria
MSKGEELFTGVVPILVELDGDVNGHKFSVSGEGEGDATYGKLTLKFICTTGKLPVPWPTLVTTFGYGVQCFARYPDHMRRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 48 - protein, 239 aa, Aequorea victoria
MVSKGEELFTGVVPILVELDGDVNGHKFSVSGEGEGDATYGKLTLKLICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 49 - protein, 239 aa, Aequorea victoria
MVSKGEELFTGVVPILVELDGDVNGHKFSVSGEGEGDATYGKLTLKLLCTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALFKDPNEKRDHMVLLEFLTAAGITEGMNELYK

SEQ ID NO: 50 - protein, 239 aa, Aequorea victoria
MVSKGEELFTGVVPILVELDGDVNGHKFSVSGEGEGDATYGKLTLKLICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 51 - protein, 239 aa, Aequorea victoria
MVSKGEELFTGVVPILVELDGDVNGHKFSVRGEGEGDATNGKLTLKFICTSGKLPVPWPTLVTTLSYGVQCFARYPDHMKQHDFFKSAMPEGYVQERTISFKDDGSYRTRAEVKFEGDTLVNRIELKGIDFKEDGNILGHKLEYNMNVWDAYITADKQKNGIKANFKIEHNVEDGGVQLADAYQQNTPIGDGSVLLPDNHYLSFQSKLFKDPNEQRDHMVLLEFVTAAGITPGMDELYK

SEQ ID NO: 52 - protein, 233 aa, Entacmaea quadricolor
MSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 53 - protein, 238 aa, Aequorea macrodactyla
MSGGEELFAGIVPVLIELDGDVHGHKFSVRGEGEGDADYGKLEIKFICTTGKLPVPWPTLVTTLAWGIQCFARYPEHMKMNDFFKSAMPEGYIQERTIHFQDDGKYKTRGEVKFEGDTLVNRVELKGEGFKEDGNILGHKLEYSAISDNVYIMPDKANNGLEANFKIRHNIEGGGVQLADHYQTNVPLGDGPVLIPINHYLSCQSAISKDRNEARDHMVLLESFSAYCHTHGMDELYR

SEQ ID NO: 54 - protein, 229 aa, Aequorea macrodactyla
MALSNKFIGDDMKMTYHMDGCVNGHYFTVKGEGSGKPYEGTQTSTFKVTMANGGPLAFSFDILSTVFMYGNRCFTAYPTSMPDYFKQAFPDGMSYERTFTYEDGGVATASWEISLKGNCFEHKSTFHGVNFPADGPVMAKMTTGWDPSFEKMTVCDGILKGDVTAFLMLQGGGNYRCQFHTSYKTKKPVTMPPNHAVEHRIARTDLDKGGNSVQLTEHAVAHITSVVPF

SEQ ID NO: 55 - protein, 232 aa, Acropora sp.
MVSYSKQGIAQEMRTKYRMEGSVNGHEFTIEGVGTGNPYEGKQMSELVIIKSKGKPLPFSFDILSTAFQYGNRCFTKYPADMPDYFKQAFPDGMSYERSFLFEDGGVATASWSIRLEGNCFIHNSIYHGVNFPADGPVMKKQTIGWDKSFEKMSVAKEVLRGDVTQFLLLEGGGYQRCRFHSTYKTEKPVAMPPSHVVEHQIVRTDLGQTAKGFKVKLEEHAEAHVNPLKVK

SEQ ID NO: 56 - protein, 236 aa, Clavularia sp.
MVSKGEETTMGVIKPDMKIKLKMEGNVNGHAFVIEGEGEGKPYDGTNTINLEVKEGAPLPFSYDILTTAFAYGNRAFTKYPDDIPNYFKQSFPEGYSWERTMTFEDKGIVKVKSDISMEEDSFIYEIHLKGENFPPNGPVMQKKTTGWDASTERMYVRDGVLKGDVKHKLLLEGGGHHRVDFKTIYRAKKAVKLPDYHFVDHRIEILNHDKDYNKVTVYESAVARNSTDGMDELYK

SEQ ID NO: 57 - protein, 225 aa, Galaxea fascicularis
MSVIKPEMKIKLCMRGTVNGHNFVIEGEGKGNPYEGTQILDLNVTEGAPLPFAYDILTTVFQYGNRAFTKYPADIQDYFKQTFPEGYHWERSMTYEDQGICTATSNISMRGDCFFYDIRFDGVNFPPNGPVMQKKTLKWEPSTEKMYVRDGVLKGDVNMALLLEGGGHYRCDFKTTYKAKKDVRLPDYHFVDHRIEILKHDKDYNKVKLYENAVARYSMLPSQAK

SEQ ID NO: 58 - protein, 236 aa, Clavularia sp.
MVSKGEETTMGVIKPDMKIKLKMEGNVNGHAFVIEGEGEGKPYDGTNTINLEVKEGAPLPFSYDILTTAFSYGNRAFTKYPDDIPNYFKQSFPEGYSWERTMTFEDKGIVKVKSDISMEEDSFIYEIHLKGENFPPNGPVMQKETTGWDASTERMYVRDGVLKGDVKMKLLLEGGGHHRVDFKTIYRAKKAVKLPDYHFVDHRIEILNHDKDYNKVTVYEIAVARNSTDGMDELYK

SEQ ID NO: 59 - protein, 231 aa, Clavularia sp.
MAQSKHGLTKEMTMKYRMEGCVDGHKFVITGEGIGYPFKGKQAINLCVVEGGPLPFAEDILSAAFNYGNRVFTEYPQDIVDYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALP

SEQ ID NO: 60 - protein, 238 aa, Aequorea macrodactyla
MSGGEELFAGVVPILVELDGDVNGHKFSVSGEGEGDATYGKLTLKFICTTGKLPVPWPTLVTTLCYGVQCFSRYPDHMKQHDFFKSAMPEGYVQERTILFKDDGNYKTRAEVKFEGDTLVNRIELKGKDFKEDGNILGHKLEYSYNSHNVYIMADKQKNGIEVNFKTRHNIEDGSVQLADHYQQNTPIGDGPVLLPDNHYLSTQSALSKDPNEARDHMVLLELSTAACITHGMDELYR

SEQ ID NO: 61 - protein, 238 aa, Aequorea macrodactyla
MSGGEELFAGIVPVLIELDGDVHGHKFSVRGEGEGDADYGKLEIKFICTTGKLPVPWPTLVTTLCYGIQCFARYPEHMKMNDFFKSAMPEGYIQERTIQFQDDGKYKTRGEVKFEGDTLVNRIELKGKDFKEDGNILGHKLEYSFNSHNVYIRPDKANNGLEANFKTRHNIEGGGVQLADHYQTNVPLGDGPVLIPINHYLSTQTKISKDRNEARDHMVLLESFSACCHTHGMDELYR

SEQ ID NO: 62 - protein, 232 aa, Pontellina plumata
MESDESGLPAMEIECRITGTLNGVEFELVGGGEGTPEQGRMTNKMKSTKGALTFSPYLLSHVMGYGFYHFGTYPSGYENPFLHAINNGGYTNTRIEKYEDGGVLHVSFSYRYEAGRVIGDFKVMGTGFPEDSVIFTDKIIRSNATVEHLHPMGDNDLDGSFTRTFSLRDGGYYSSVVDSHMHFKSAIHPSILQNGGPMFAFRRVEEDHSNTELGIVEYQHAFKTPDADAGEE

SEQ ID NO: 63 - protein, 222 aa, Pontellina plumata [sequence omitted]

SEQ ID NO: 64 - protein, 238 aa, Aequorea coerulescens
MSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 65 - protein, 239 aa, Aequorea macrodactyla
MVSKGEELFAGIVPVLIELDGDVHGHKFSVRGEGEGDADYGKLEIKFICTTGKLPVPWPTLVTTLTYGVQCFARYPKHMKMNDFFKSAMPEGYIQERTILFQDDGKYKTRGEVKFEGDTLVNRIELKGKDFKEDGNILGHKLEYSFNSHNVYITPDKANNGLEVNFKTRHNIEGGGVQLADHYQTNVPLGDGPVLIPINHYLSYQTDISKDRNEARDHMVLLESVSACSHTHGMDELYR

SEQ ID NO: 66 - protein, 231 aa, Zoanthus sp.
MAHSKHGLKEEMTMKYHMEGCVNGHKFVITGEGIGYPFKGKQTINLCVIEGGPLPFSEDILSAGFKYGDRIFTEYPQDIVDYFKNSCPAGYTWGRSFLFEDGAVCICNVDITVSVKENCIYHKSIFNGVNFPADGPVMKKMTTNWEASCEKIMPVPKQGILKGDVSMYLLLKDGGRYRCQFDTVYKAKSVPSKMPEWHFIQHKLLREDRSDAKNQKWQLTEHAIAFPSALA

SEQ ID NO: 67 - protein, 234 aa, Phialidium sp.
MSSGALLFHGKIPYVVEMEGNVDGHTFSIRGKGYGDASVGKVDAQFICTTGDVPVPWSTLVTTLTYGAQCFAKYGPELKDFYKSCMPEGYVQERTITFEGDGVFKTRAEVTFENGSVYNRVKLNGQGFKKDGHVLGKNLEFNFTPHCLYIWGDQANHGLKSAFKIMHEITGSKEDFIVADHTQMNTPIGGGPVHVPEYHHITYHVTLSKDVTDHRDNMSLVETVRAVDCRKTYL

SEQ ID NO: 68 - protein, 217 aa, Verrillofungia concinna
MSVIKPEMKMKYFMDGSVNGHEFTVEGEGTGKPYEGHQEMTLRVTMAKGGPMPFSFDLVSHTFCYGHRPFTKYPEEIPDYFKQAFPEGLSWERSLQFEDGGFAAVSAHISLRGNCFEHKSKFVGVNFPADGPVMQNQSSDWEPSTEKITTCDGVLKGDVTMFLKLAGGGNHKCQFKTTYKAAKKILKMPQSHFIGHRLVRKTEGNITELVEDAVAHC

SEQ ID NO: 69 - protein, 218 aa, Verrillofungia concinna
MVSVIKPEMKMRYYMDGSVNGHEFTIEGEGTGRPYEGHQEMTLRVTMAEGGPMPFAFDLVSHVFCYGHRVFTKYPEEIPDYFKQAFPEGLSWERSLEFEDGGSASVSAHISLRGNTFYHKSKFTGVNFPADGPIMQNQSVDWEPSTEKITASDGVLKGDVTMYLKLEGGGNHKCQMKTTYKAAKEILEMPGDHYIGHRLVRKTEGNITEQVEDAVAHS

SEQ ID NO: 70 - protein, 236 aa, Discosoma sp.
MVSKGEENNMAIIKEFMRFKVRMEGSVNGHEFEIEGEGEGRPYEGFQTAKLKVTKGGPLPFAWDILSPQFTYGSKAYVKHPADIPDYFKLSFPEGFKWERVMNFEDGGVVTVTQDSSLQDGEFIYKVKLRGTNFPSDGPVMQKKTMGWEASSERMYPEDGALKGEIKMRLKLKDGGHYTSEVKTTYKAKKPVQLPGAYIVGIKLDITSHNEDYTIVEQYERAEGRHSTGGMDELYK

SEQ ID NO: 71 - protein, 236 aa, Discosoma sp.
MVSKGEENNMAIIKEFMRFKVRMEGSVNGHEFEIEGEGEGRPYEGFQTAKLKVTKGGPLPFAWDILSPHFTYGSKAYVKHPADIPDYFKLSFPEGFKWERVMNYEDGGVVTVTQDSSLQDGEFIYKVKLRGTNFPSDGPVMQKKTMGWEASSERMYPEDGALKGKIKMRLKLKDGGHYTSEVKTTYKAKKPVQLPGAYIVDIKLDITSHNEDYTIVEQYERAEGRHSTGGMDELYK

SEQ ID NO: 72 - protein, 234 aa, Discosoma sp.
MVSKGEEVIKEFMRFKVRMEGSMNGHEFEIEGEGEGRPYEGTQTAKLKVTKGGPLPFAWDILSPQFMYGSKAYVKHPADIPDYKKLSFPEGFKWERVMNFEDGGLVTVTQDSSLQDGTLIYKVKMRGTNFPPDGPVMQKKTMGWEASTERLYPRDGVLKGEIHQALKLKDGGHYLVEFKTIYMAKKPVQLPGYYYVDTKLDITSHNEDYTIVEQYERSEGRHHLFLYGMDELYK

SEQ ID NO: 73 - protein, 476 aa, Discosoma sp.
MVSKGEEVIKEFMRFKVRMEGSMNGHEFEIEGEGEGRPYEGTQTAKLKVTKGGPLPFAWDILSPQFMYGSKAYVKHPADIPDYKKLSFPEGFKWERVMNFEDGGLVTVTQDSSLQDGTLIYKVKMRGTNFPPDGPVMQKKTMGWEASTERLYPRDGVLKGEIHQALKLKDGGHYLVEFKTIYMAKKPVQLPGYYYVDTKLDITSHNEDYTIVEQYERSEGRHHLFLGHGTGSTGSGSSGTASSEDNNMAVIKEFMRFKVRMEGSMNGHEFEIEGEGEGRPYEGTQTAKLKVTKGGPLPFAWDILSPQFMYGSKAYVKHPADIPDYKKLSFPEGFKWERVMNFEDGGLVTVTQDSSLQDGTLIYKVKMRGTNFPPDGPVMQKKTMGWEASTERLYPRDGVLKGEIHQALKLKDGGHYLVEFKTIYMAKKPVQLPGYYYVDTKLDITSHNEDYTIVEQYERSEGRHHLFLYGMDELYK

SEQ ID NO: 74 - protein, 225 aa, Discosoma sp.
MRSSKNVIKEFMRFKVRMEGTVNGHEFEIEGEGEGRPYEGHNTVKLKVTKGGPLPFAWDILSPQFQYGSKVYVKHPADIPDYKKLSFPEGFKWERVMNFEDGGVVTVTQDSSLQDGCFIYKVKFIGVNFPSDGPVMQKKTMGWEASTERLYPRDGVLKGEIHKALKLKDGGHYLVEFKSIYMAKKPVQLPGYYYVDSKLDITSHNEDYTIVEQYERTEGRHHLFL

SEQ ID NO: 75 - protein, 225 aa, Discosoma sp.
MASSENVITEFMRFKVRMEGTVNGHEFEIEGEGEGRPYEGHNTVKLKVTKGGPLPFAWDILSPQFQYGSKVYVKHPADIPDYKKLSFPEGFKWERVMNFEDGGVATVTQDSSLQDGCFIYKVKFIGVNFPSDGPVMQKKTMGWEASTERLYPRDGVLKGETHKALKLKDGGHYLVEFKSIYMAKKPVQLPGYYYVDAKLDITSHNEDYTIVEQYERTEGRHHLFL

SEQ ID NO: 76 - protein, 225 aa, Discosoma sp.
MASSEDVIKEFMRFKVRMEGSVNGHEFEIEGEGEGRPYEGTQTAKLKVTKGGPLPFAWDILSPQFQYGSKVYVKHPADIPDYKKLSFPEGFKWERVMNFEDGGVVTVTQDSSLQDGSFIYKVKFIGVNFPSDGPVMQKKTMGWEASTERLYPRDGVLKGEIHKALKLKDGGHYLVEFKSIYMAKKPVQLPGYYYVDSKLDITSHNEDYTIVEQYERAEGRHHLFL

SEQ ID NO: 77 - protein, 225 aa, Discosoma sp.
MDSTENVIKPFMRFKVHMEGSVNGHEFEIEGEGEGKPYEGTQTAKLQVTKGGPLPFAWDILSPQFQYGSKVYVKHPADIPDYKKLSFPEGFKWERVMNFEDGGVVTVTQDSSLQDGTFIYHVKFIGVNFPSDGPVMQKKTLGWEPSTERLYPRDGVLKGEIHKALKLKGGGHYLVEFKSIYMAKKPVKLPGYYYVDSKLDITSHNEDYTVVEQYERAEARHHLFQ

SEQ ID NO: 78 - protein, 225 aa, Discosoma sp.
MDSTENVIKPFMRFKVHMEGSVNGHEFEIEGEGEGKPYEGTQTAKLQVTKGGPLPFAWDILSPQFMYGSKVYTKHPADIPDYKKLSFPEGFKWERVMNFEDGGVVTVTQDSSLQDGTFIYHVKFIGVNFPSDGPVMQKKTLGWEPSTERLYPRDGVLKGEIHKALKLKGGGHYLCEFKSIYMAKKPVKLPGYYYVDSKLDITSHNEDYTVVEQYERTEARHHLFQ

SEQ ID NO: 79 - protein, 225 aa, Discosoma sp.
MDNTEDVIKEFMQFKVRMEGSVNGHYFEIEGEGEGKPYEGTQTAKLQVTKGGPLPFAWDILSPQFQYGSKAYVKHPADIPDYMKLSFPEGFTWERSMNFEDGGVVEVQQDSSLQDGTFIYKVKFKGVNFPADGPVMQKKTAGWEPSTEKLYPQDGVLKGEISHALKLKDGGHYTCDFKTVYKAKKPVQLPGNHYVDSKLDITNHNEDYTVVEQYEHAEARHSGSQ

SEQ ID NO: 80 - protein, 231 aa, Entacmaea quadricolor
MSELIKENMHMKLYMEGTVNNHHFKCTSEGEGKPYEGTQTMKIKVVEGGPLPFAFDILATSFMYGSKAFINHTQGIPDFFKQSFPEGFTWERITTYEDGGVLTATQDTSFQNGCIIYNVKINGVNFPSNGPVMQKKTRGWEANTEMLYPADGGLRGHSQMALKLVGGGYLHCSFKTTYRSKKPAKNLKMPGFHFVDHRLERIKEADKETYVEQHEMAVAKYCDLPSKLGHR

SEQ ID NO: 81 - protein, 231 aa, Entacmaea quadricolor
MSELIKENMHMKLYMEGTVNNHHFKCTSEGEGKPYEGTQTMRIKVVEGGPLPFAFDILATSFMYGSRTFINHTQGIPDFFKQSFPEGFTWERVTTYEDGGVLTATQDTSLQDGCLIYNVKIRGVNFPSNGPVMQKKTLGWEANTEMLYPADGGLEGRSDMALKLVGGGHLICNFKTTYRSKKPAKNLKMPGVYYVDHRLERIKEADKETYVEQHEVAVARYCDLPSKLGHK

SEQ ID NO: 82 - protein, 244 aa, Entacmaea quadricolor
MVSKGEELIKENMHMKLYMEGTVNNHHFKCTSEGEGKPYEGTQTMRIKVVEGGPLPFAFDILATSFMYGSRTFINHTQGIPDFFKQSFPEGFTWERVTTYEDGGVLTATQDTSLQDGCLIYNVKIRGVNFPSNGPVMQKKTLGWEANTEMLYPADGGLEGRTDMALKLVGGGHLICNFKTTYRSKKPAKNLKMPGVYYVDHRLERIKEADKETYVEQHEVAVARYCDLPSKLGHKLNGMDELYK

SEQ ID NO: 83 - protein, 227 aa, Entacmaea quadricolor
MNSLIKENMRMKVVLEGSVNGHQFKCTGEGEGNPYMGTQTMRIKVIEGGPLPFAFDILATSFMYGSRTFIKYPKGIPDFFKQSFPEGFTWERVTRYEDGGVITVMQDTSLEDGCLVYHAQVRGVNFPSNGAVMQKKTKGWEPNTEMMYPADGGLRGYTHMALKVDGGGHLSCSFVTTYRSKKTVGNIKMPGIHAVDHRLERLEESDNEMFVVQREHAVAKFAGLGGG

SEQ ID NO: 84 - protein, 236 aa, Discosoma sp.
MVSKGEENNMAIIKEFMRFKVHMEGSVNGHEFEIEGEGEGRPYEAFQTAKLKVTKGGPLPFAWDILSPQFMYGSKVYIKHPADIPDYFKLSFPEGFRWERVMNFEDGGIIHVNQDSSLQDGVFIYKVKLRGTNFPSDGPVMQKKTMGWEASEERMYPEDGALKSEIKKRLKLKDGGHYAAEVKTTYKAKKPVQLPGAYIVDIKLDIVSHNEDYTIVEQYERAEGRHSTGGMDELYK

SEQ ID NO: 85 - protein, 236 aa, Discosoma sp.
MVSKGEENNMAIIKEFMRFKVRMEGSVNGHEFEIEGEGEGRPYEGTQTAKLKVTKGGPLPFAWDILTPNFTYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKMRLKLKDGGHYDAEVKTTYKAKKPVQLPGAYIVGIKLDITSHNEDYTIVELYERAEGRHSTGGMDELYK

SEQ ID NO: 86 - protein, 231 aa, Anemonia sulcata
MASLLKKTMPFRTTIEGTVNGHYFKCTGKGEGNPLEGTQEMKIEVIEGGPLPFAFHILSTSCMYGSKAFIKYVSGIPDYFKQSLPEGFTWERTTTYEDGGFLTAHQDTSLDGDCLVYKVKILGNNFPADGPVMQNKAGRWEPSTEIVYEVDGVLRGQSLMALECPGGRHLTCHLHTTYRSKKPASALKMPGFHFEDHRIEILEEVEKGKCYKQYEAAVGRYCDAAPSKLGH

SEQ ID NO: 87 - protein, 225 aa, Discosoma sp.
MASSEDVIKEFMRFKVRMEGSVNGHEFEIEGEGEGRPYEGTQTAKLKVTKGGPLPFAWDILSPQFQYGSKAYVKHPADIPDYLKLSFPEGFKWERVMNFEDGGVVTVTQDSSLQDGEFIYKVKLRGTNFPSDGPVMQKKTMGWEASTERMYPEDGALKGEIKMRLKLKDGGHYDAEVKTTYMAKKPVQLPGAYKTDIKLDITSHNEDYTIVEQYERAEGRHSTGA

SEQ ID NO: 88 - protein, 268 aa, Anthoathecata
MDEDGSEGGPALFQSDMTFKIFIDGEVNGQKFTIVADGSSKFPHGDFNVHAVCETGKLPMSWKPICHLIQYGEPFFARYPNGISHFAQECFPEGLSIDRTVRFENDGTMTSHHTYELDGTCVVSRITVNCDGFQPDGPIMRDQLVDILPNETHMFPHGPNAVRQLAFIGFTTADGGLMMGHFDSKMTFNGSRAIKIPGPHFVTIITKQMRDTSDKRDHVCQREVTYAHSVPRITSAIGSDEDSGLRSRAQASNSAVDGTAGPGSTGSR

SEQ ID NO: 89 - protein, 236 aa, Discosoma sp.
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 90 - protein, 231 aa, Entacmaea quadricolor
MNSLIKENMRMMVVMEGSVNGYQFKCTGEGDGNPYMGTQTMRIKVVEGGPLPFAFDILATSFMYGSKTFIKHTKGIPDFFKQSFPEGFTWERVTRYEDGGVFTVMQDTSLEDGCLVYHAKVTGVNFPSNGAVMQKKTKGWEPNTEMLYPADGGLRGYSQMALNVDGGGYLSCSFETTYRSKKTVENFKMPGFHFVDHRLERLEESDKEMFVVQHEHAVAKFCDLPSKLGRL

SEQ ID NO: 91 - protein, 231 aa, Entacmaea quadricolor
MNSLIKENMRMMVVMEGSVNGYQFKCTGEGDGNPYMGTQTMRIKVVEGGPLPFAFDVLATSFMYGSKTFIKHTKGIPDFFKQSFPEGFTWERVTRYEDGGVITVMQDTSLEDGCLVYHAKVRGVNFPSNGAVMQKKTKGWEPNTEMLYPADGGLRGYSQMALNVDGGGYLFCSFETTYRSKKTDENFKMPGFHFVDHRLERLEESDKEMFVVQHEHAVAKFCDLPSKLGRL

SEQ ID NO: 92 - protein, 227 aa, Heteractis crispa
MAGLLKESMRIKMYMEGTVNGHYFKCEGEGDGNPFAGTQSMRIHVTEGAPLPFAFDILAPCCEYGSRTFVHHTAEIPDFFKQSFPEGFTWERTTTYEDGGILTAHQDTSLEGNCLIYKVKVHGTNFPADGPVMKNKSGGWEPSTEVVYPENGVLCGRNVMALKVGDRHLICHHYTSYRSKKAVRALTMPGFHFTDIRLQMLRKKKDEYFELYEASVARYSDLPEKAN

SEQ ID NO: 93 - protein, 226 aa, Discosoma sp.
MVSKGEEVIKEFMRFKVRMEGSVNGHEFEIEGEGEGRPYEGTQTAKLKVTKGGPLPFAWDILSPQCMYGSKGYVKHPADIPDYLKLSFPEGFKWERVMNFEDGGVVTVTQDSSLQDGEFIYKVKLRGTNFPSDGPVMQKKTMGWEASSERMYPEDGALKGEMKMRLKLKDGGHYDAEVKTTYMAKKPVQLPGAYKTDIKLDITSHNEDYTIVEQYERAEGRHSTGA

SEQ ID NO: 94 - protein, 231 aa, Entacmaea quadricolor
MNSLIKENMRMMVVMEGSVNGYQFKCTGEGDGNPYMGTQTMRIKVVEGGPLPFAFDILATSFMYGSKTFIKHTKGIPDFFKQSFPEGFTWERVTRYEDGGVFTVMQDTSLEDGCLVYHAKVRGVNFPSNGAVMQKKTKGWEPSTEMLYPADGGLRGYCQMALNVDGGGYLFCSFETTYRSKKTDENFKMPGFHFVDHRLERLEESDKEMFVVQHEHAVAKFCDLPSKLGRL

SEQ ID NO: 95 - protein, 231 aa, Entacmaea quadricolor
MSELIKENMHMKLYMEGTVNNHHFKCTSEGEGKPYEGTQTMRIKVVEGGPLPFAFDILATSFMYGSKTFINHTQGIPDFFKQSFPEGFTWERVTTYEDGGVLTATQDTSLQDGCLIYNVKIRGVNFPSNGPVMQKKTLGWEASTEMLYPADGGLEGRSDMALKLVGGGHLICNLKTTYRSKKPAKNLKMPGVYYVDRRLERIKEADKETYVEQHEVAVARYCDLPSKLGHK

SEQ ID NO: 96 - protein, 232 aa, Entacmaea quadricolor
MVSELIKENMHMKLYMEGTVNNHHFKCTSEGEGKPYEGTQTMRIKAVEGGPLPFAFDILATSFMYGSKTFINHTQGIPDFFKQSFPEGFTWERVTTYEDGGVLTATQDTSLQDGCLIYNVKIRGVNFPSNGPVMQKKTLGWEASTETLYPADGGLEGRADMALKLVGGGHLICNLKTTYRSKKPAKNLKMPGVYYVDRRLERIKEADKETYVEQHEVAVARYCDLPSKLGHR

SEQ ID NO: 97 - protein, 231 aa, Entacmaea quadricolor
MSVLITENMHMKLYMEGTVNDHHFKCTSEGEGKPYEGTQTMKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHSQMALKLVGGGYLHCSLKTTYRSKKPAKNLKMPGFYFVDRRLERIKEADKETYVEQHEMAVARYCDLPSKLGHS

SEQ ID NO: 98 - protein, 231 aa, Entacmaea quadricolor
MSELIKENMHMKLYMEGTVNNHHFKCTSEGEGKPYEGTQTMKIKVVEGGPLPFAFDILATSFMYGSKTFINHTQGIPDFFKQSFPEGFTWERITTYEDGGVLTATQDTSLQNGCIIYNVKINGVNFPSNGSVMQKKTLGWEANTEMLYPADGGLRGHSQMALKLVGGGYLHCSFKTTYRSKKPAKNLKMPGFHFVDHRLERIKEADKETYVEQHEMAVAKYCDLPSKLGHR

SEQ ID NO: 99 - protein, 226 aa, Discosoma sp.
MVSKGEEVIKEFMRFKEHMEGSVNGHEFEIEGEGEGRPYEGTQTARLKVTKGGPLPFAWDILSPQIMYGSKAYVKHPADIPDYLKLSFPEGFKWERVMNFEDGGVVTVTQDSSLQDGEFIYKVKVRGTNFPSDGPVMQKKTMGWEASSERMYPEDGALKGEMKMRLRLKDGGHYDAEVKTTYMAKKPVQLPGAYKTDIKLDITSHNEDYTIVEQYERAEGRHSTGA

SEQ ID NO: 100 - protein, 231 aa, Actinia equina
MAPLVTEDMCIKMTMEGTINGHHFKCVGEGEGKPFEGTQVEKIRITEGGPLPFAYDILAPCCMYGSKTFIKHVSGIPDYFKESFPEGFTWERTQIFEDGGSLTIHQDTSLQGNNFIFKVNVIGANFPANGPVMQKKTAGWEPSVEILYPRDGVLCGQALMALKCTDGDHLTSHLRTTYRSRKPSNAVNMPEFHFGDHRIEILKAEQGKFYEQYESAVARYCEAAPSKLGHH

SEQ ID NO: 101 - protein, 231 aa, Aequorea victoria; identical to SEQ ID NO: 100

SEQ ID NO: 102 - protein, 238 aa, Aequorea coerulescens
MSKGAELFTGIVPILIELNGDVNGHKFSVSGEGEGDATYGKLTLKFICTTGKLPVPWPTLVATLSYGVQCFSRYPDHMKQHDFFKSAMPEGYIQERTIFFEDDGNYKTRAEVKFEGDTLVSRIELTGTDFKEDGNILGNKMEYNYNATNVYIVADKARNGIKVNFKVRHNIKDGSVQLADHYQQNTPIGDGPVLLPDNHYLSTQSALSKDPNEKRDHMIYLEFVTAAAITHGMDELYK

SEQ ID NO: 103 - protein, 236 aa, Discosoma sp.
MVSKGEEDNMAIIKEFMRFKVHMEGSVNGHVFEIEGEGEGRPYEGTQTAKLKVTKGGPLPFTWDILSPQFMYGSNAYVKHPADIPDYFKLSFPEGFKWERVMKFEDGGVVTVTQDSSLQDGEFIYKVKLRGTNFPSDGPVMQKKTMGWEALSERMYPEDGALKGEVKPRVKLKDGGHYDAEVKTTYKAKKPVQLPGAYNVNRKLDITSHNEDYTIVEQYERAEGRHSTGGMDELYK

SEQ ID NO: 104 - protein, 466 aa, Artificial Sequence
  Synthetic Construct
MVSKGEELFTGVVPILVELDGDVNGHRFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNYISHNVYITADKQKNGIKAHFKIRHNIEDGGVQLADHYQQNTPIGDGPVLLPDNHYLSTQSKLSKDPNEKRDHMVLLEFVTAAGTKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSHQSALSKDPNEKRDHMVLLEFVTAAGITLGMDELYK

SEQ ID NO: 105 - protein, 225 aa, Trachyphyllia geoffroyi
MSLIKPEMKIKLLMEGNVNGHQFVIEGDGKGHPFEGKQSMDLVVKEGAPLPFAYDILTTAFHYGNRVFAKYPDHIPDYFKQSFPKGFSWERSLMFEDGGVCIATNDITLKGDTFFNKVRFDGVNFPPNGPVMQKKTLKWEASTEKMYLRDGVLTGDITMALLLKGDVHYRCDFRTTYKSRQEGVKLPGYHFVDHCISILRHDKDYNEVKLYEHAVAHSGLPDNVK

SEQ ID NO: 106 - protein, 227 aa, Favia favus
MSVITSEMKIELRMEGAVNGHKFVITGKGSGQPFEGIQNVDLTVIEGGPLPFAFDILTTAFHYGNRVFVEYPEEIVDYFKQSFPEGYSWERSMSYEDGGICLATNNITMKKDGSNCFVNEIRFDGVNFPANGPVMQRKTVKWEPSTEKMYVRDGVLKGDVNMALLLQGGGHYRCDFRTTYKAKKVVQLPDYHFVDHQMEITSHDKDYNKVKLYEHAKAHSGLPRLAK

SEQ ID NO: 107 - protein, 232 aa, Favia favus
MSVITSEMKIELRMEGSVNGHKFVITGKGSGRPYEGTQTVDLTVIEGGPLPFAFDILTTAFHYGNRVFVEYPEEIVDYFKQSFPEGYSWERSMSYEDGGICLATNNITMKKDGSNTFVNEIRFDGTNFPANGPVMQRKTVKWEPSTEKMYVRDGVLKGDVEMALLLEGGGHYRCDFRTTYKAKKVVQLPDYHYVDHQMEITSHDKDYNKVKAYEHAKAYSGTYRGAKYEFEA

SEQ ID NO: 108 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFAEYPDHIQDYFKQSFPKGYSWERSLTFEDGGICIARNDITMEGDTFYNKVRFHGVNFPANGPVMQKKTLKWEPSTEKMYVRDGVLTGDITMALLLEGNAHYRCDFRTTYKAKEKGVKLPGYHFVDHCIEILSHDKDYNKVKLYEHAVAHSGLPDNARR

SEQ ID NO: 109 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFAEYPDHIQDYFKQSFPKGYSWERSLTFEDGGICIARNDITMEGDTFYNKVRFHGTNFPANGPVMQKKTLKWEPSTEKMYVRDGVLTGDITMALLLEGNAHYRCDFRTTYKAKEKGVKLPGYHFVDHCIEILSHDKDYNKVKLYEHAVAHSGLPDNARR

SEQ ID NO: 110 - protein, 226 aa, Lobophyllia hemprichii
MSAIKPDMKIKLRMEGNVNGHHFVIDGDGTGKPFEGKQSMDLEVKEGGPLPFAFDILTTAFHYGNRVFAKYPDNIQDYFKQSFPKGYSWERSLTFEDGGICIARNDITMEGDTFYNKVRFYGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 111 - protein, 230 aa, Dendronephthya sp.
MNTPGINLIKEDMRVKVHMEGNVNGHAFVIEGEGKGKPYEGTQTANLTVKEGAPLPFSYDILTTAVHYGNRVFTKYPEDIPDYFKQSFPEGYSWERTMTFEDKGICTIRSDISLEGDCFFQNVRFKGTNFPPNGPVMQKKTLKWEPSTEKLHVRDGLLVGNINMALLLEGGGHYLCDFKTTYKAKKVVQLPDAHFVDHRIEILGNDSDYNKVKLYEHAVARYSPLPSQVW

SEQ ID NO: 112 - protein, 224 aa, Echinophyllia sp. SC22
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDVNMALSLEGGGHYRCDFKTTYKAKKVVQLPDYHFVDHHIEIKSHDKDYSNVNLHEHAEAHSELPRQAK

SEQ ID NO: 113 - protein, 224 aa, Echinophyllia sp. SC22
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDINAALSLEGGGHYRCDFKTTYKAKKVVQLPDYHFVDHHIEIKSHDKDYSNVNLHEHAEAHSELPRQAK

SEQ ID NO: 114 - protein, 224 aa, Echinophyllia sp. SC22
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDGNMALSLEGGGHYRCDFKTTYKAKKVVQLPDYHFVDHHIEIKSHDKDYSNVNLHEHAEAHSELPRQAK

SEQ ID NO: 115 - protein, 224 aa, Echinophyllia sp. SC22
MSVIKPDMKIKLRMEGAVNGHPFAIEGVGLGKPFEGKQSMDLKVKEGGPLPFAYDILTMAFCYGNRVFAKYPENIVDYFKQSFPEGYSWERSMIYEDGGICNATNDITLDGDCYIYEIRFDGVNFPANGPVMQKRTVKWELSTEKLYVRDGVLKSDGNYALSLEGGGHYRCDFKTTYKAKKVVQLPDYHSVDHHIEIKSHDKDYSNVNLHEHAEAHSELPRQAK

SEQ ID NO: 116 - protein, 224 aa, Echinophyllia sp. SC22
MSVIKPDMKIKLRMEGAVNGHPFAIEGVGLGKPFEGKQSMDLKVKEGGPLPFAYDILTTAFCYGNRVFTKYPENIVDYFKQSFPEGYSWERSMNYEDGGICNATNDITLDGNCYIYEIRFDGVNFPANGPVMQKRTVKWEQSTEKLYVRDGVLKSDGNCALSLEGGGHYRCDCKTTYKAKKVVQLPDYHFVDHHIEIKSHDKDYSNVNLHEHAEAHSELPRQAK

SEQ ID NO: 117 - protein, 232 aa, Anemonia sulcata
MASLLTETMPFKTTIEGTVNGHCFKCIGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKVGRWEPGTEIVYEVDGVLRGQSLMALKCPGGRHLTCHLHTTYRSKKPASALKMPGFHFEDHRIEIMEEVEKGKCYKQYEAAVGRYCDAAPSKLGHN

SEQ ID NO: 118 - protein, 236 aa, Clavularia sp.
MVSKGEETTMGVIKPDMKIKLKMEGNVNGHAFVIEGEGEGKPYDGTNTINLEVKEGAPLPFSYDILTNAFAYGNRAFTKYPDDIPNYFKQSFPEGYSWERTMTFEDKGIVKVKSDISMEEDSFIYEIHLKGENFPPNGPVMQKKTLKWEPSTEILYVRDGVLVGDIKHKLLLEGGGHHRVDFKTIYRAKKAVKLPDYHFVDHRIEILNHDKDYNKVTVYESAVARYSTGGMDELYK

SEQ ID NO: 119 - protein, 236 aa, Discosoma sp.
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWVASSERMYPEDGALKGESKQRLKLKDGGHYDAEFWTTYKAKKPVQLPGAYNVNIKLDITSHNEDYTIVEQYERAEGRHSTGGMDELYK

SEQ ID NO: 120 - protein, 236 aa, Discosoma sp.
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWVACSERMYPEDGALKGESKMRLKLKDGGHYDAEFKTTYKAKKPVQLPGAYNVNIKLDITSHNEDYTIVEQYERAEGRHSTGGMDELYK

SEQ ID NO: 121 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFAEYPDHIQDYFKQSFPKGYSWERSLTFEDGGICIARNDITMEGDTFYNKVRFHGVNFPANGPVMQKKTLKWEPSTEKMYVRDGVLTGDITMALLLEGNAHYRCDSRTTYKAKEKGVKLPGYHLVDHCIEILSHDKDYNKVKLYEHAVAHSGLPDNARR

SEQ ID NO: 122 - protein, 237 aa, Canavalia cathartica
ADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNSTHETNALHFMFNQFSKDQKDLILQGDATTGTDGNLELTRVSSNGSPQGNSVGRALFYAPVHIWESSAVVASFDATFTFLIKSPDSHPADGIAFFISNIDSSIPSGSTGRLLGLFPDAN

SEQ ID NO: 123 - protein, 237 aa, Canavalia cathartica
ADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNSTHETNALHFVFNQFSKDQKDLILQGDATTGTDGNLELTRVSSNGSPQGSSVGRALFYAPVHIWESSAVVASFDATFTFLIKSPDSHPADGIAFFISNIDSSIPSGSTGRLLGLFPDAN

SEQ ID NO: 124 - protein, 237 aa, Canavalia lineata
ADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNSTHETNALHFVFNQFSKDQKDLILQGDATTGTDGNLELTRVSSNGSPQGNSVGRALFYAPVHIWESSAVVASFDATFTFLIKSSDSHPADGIAFFISNIDSSIPSGSTGRLLGLFPDAN

SEQ ID NO: 125 - protein, 237 aa, Canavalia brasiliensis
ADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNSTHETNALHFMFNQFSKDQKDLILQGDATTGTEGNLRLTRVSSNGSPQGSSVGRALFYAPVHIWESSAVVASFEATFTFLIKSPDSHPADGIAFFISNIDSSIPSGSTGRLLGLFPDAN

SEQ ID NO: 126 - protein, 237 aa, Canavalia boliviana
ADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSATTGLYKETNTILSWSFTSKLKSNSTHETNALHFMFNQFSKDQKDLILQGDATTGRDGNLELTRVSSNGSPQGSSVGRALFYAPVHIWESSAVVASFDATFTFLIKSSDSHPADGIAFFISNIDSSIPSGSTGRLLGLFPDAN

SEQ ID NO: 127 - protein, 237 aa, Canavalia grandiflora
ADTIVAVELDTYPNTDIGDPNYPHIGIDIKSIRSKKIAKWNMQDGKVATAHIIYNSVGKRLSAVVSYPNADSATVSYDVDLDNVLPEWVRVGLSATTGLYKETNTILSWSFTSKLKSNSTAETNALHFTFNQFTKDQKDLILQGDATTDSDGNLQLTRVSSDGTPQGNSVGRALFYAPVHIWESSAVVASFDATFTFLIKSPDSDPADGITFFISNMDSTIPSGSGGRLLGLFPDAN

SEQ ID NO: 128 - protein, 236 aa, Canavalia rosea
  MISC_FEATURE (25)...(25): Xaa is any amino acid
  MISC_FEATURE (26)...(26): Xaa is any amino acid
  MISC_FEATURE (27)...(27): Xaa is any amino acid
  MISC_FEATURE (28)...(28): Xaa is any amino acid
  MISC_FEATURE (29)...(29): Xaa is any amino acid
  MISC_FEATURE (30)...(30): Xaa is any amino acid
  MISC_FEATURE (34)...(34): Xaa is any amino acid
  MISC_FEATURE (35)...(35): Xaa is any amino acid
  MISC_FEATURE (154)...(154): Xaa is any amino acid
  MISC_FEATURE (155)...(155): Xaa is any amino acid
  MISC_FEATURE (195)...(195): Xaa is any amino acid
  MISC_FEATURE (196)...(196): Xaa is any amino acid
ADTIVAVELDTYPNTDVGDPSYPHXXXXXXSVRXXTAKWNMQNGKVGTAHISYNSVGKRLSAVVSYPNGDSATVSYDVDLDNVLPEWVRVGLSASTGLYKETNTILSWSFTSKLKSNSTHETNALHFMFNQFTKDQKDLILQSDATTGTDGNLXXTRVSSNGPSQGSTVGRALFYAPVHIWESSATVAGFDATFXXLIKSPDSHPADGIAFFISNIDSSIPSGSTGRLLGLFPDAN

SEQ ID NO: 129 - protein, 237 aa, Cymbosema roseum
ADTIVAVELDSYPNTDIGDPSYPHIGIDIKSIRSKSTARWNMQTGKVGTAHISYNSVAKRLTAVVSYSGSSSTTVSYDVDLTNVLPEWVRVGLSATTGLYKETNTILSWSFTSKLKTNSIADANALHFSFNQFTQNPKDLILQGDATTDSDGNLELTKVSSSGSPQGSSVGRALFYAPVHIWESSAVVASFDATFTFLIKSPDSEPADGITFFIANTDTSIPSGSSGRLLGLFPDAN

SEQ ID NO: 130 - protein, 237 aa, Cymbosema roseum
ADTIVAVELDSYPNTDIGDPSYPHIGIDIKSIRSKSTARWNMQTGKVGTAHISYNSVAKRLTAVVSYSGSSSTTVSYDVDLNNVLPEWVRVGLSATTGLYKETNTILSWSFTSKLKTNSIADANALHFSFHQFTQNPKDLILQGDATTDSDGNLELTKVSSSGSPQGSSVGRALFYAPVHIWESSAVVASFDATFTFLIKSPDSEPADGITFFIANTDTSIPSGSSGRLLGLFPDAN

SEQ ID NO: 131 - protein, 237 aa, Dioclea virgata
ADTIVAVELDSYPNTDIGDPSYPHIGIDIKSVRSKSTARWNMQTGKVGTAHISYNSVAKRLSAVVSYTGSSSTTVSYDVDLNNVLPEWVRVGLSATTGLYKETNTILSWSFTSKLKTNSIADANSLHFSFNQFSQNPKDLILQGDATTDSDGNLQLTRVSSDGSPQGSSVGRALFYAPVHIWEKSAVVASFDATFTFLIKSPDRDPADGITFFIANTDTSIPSGSGGRLLGLFPDAN

SEQ ID NO: 132 - protein, 237 aa, Dioclea rostrata
ADTIVAVELDSYPNTDIGDPNYPHIGIDIKSIRSKSTARWNMQTGKVGTVHISYNSVAKRLSAVVSYTGSSSTTVSYDVDLNNVLPEWVRVGLSATTGLYKETNTILSWSFTSKLKTNSIADANSLHFTFNQFSQNPKDLILQGDATTDSDGNLELTKVSSSGDPQGNSVGRALFYAPVHIWEKSAVVASFDATFTFLIKSPDRDPADGITFFIANPDTSIPSGSGGRLLGLFPDAN

SEQ ID NO: 133 - protein, 237 aa, Dioclea guianensis
ADTIVAVELDSYPNTDIGDPSYPHIGIDIKSIRSKSTARWNMQTGKVGTAHISYNSVAKRLSAVVSYTGSSSTTVSYDVDLNNVLPEWVRVGLSATTGLYKETNTILSWSFTSKLKTNSIADANSLHFSFNQFSQNPKDLILQSDATTDSDGNLELTKVSSSGDPQGSSVGRALFYAPVHIWEKSAVVAGFDATFTFLIKSPDRDPADGITFFIANTDTSIPSGSGGRLLGLFPDAN

SEQ ID NO: 134 - protein, 237 aa, Dioclea grandiflora
ADTIVAVELDSYPNTDIGDPNYPHIGIDIKSIRSKSTARWNMQTGKVGTVHISYNSVAKRLSAVVSYSGSSSTTVSYDVDLNNVLPEWVRVGLSATTGLYKETNTILSWSFTSKLKTNSIADENSLHFSFHKFSQNPKDLILQGDAFTDSDGNLELTKVSSSGDPQGNSVGRALFYAPVHIWESSAVVASFDATFTFLIKSPDREPADGITFFIANTDTSIPSGSGGRLLGLFPDAN

SEQ ID NO: 135 - protein, 236 aa, Bionia pedicellata
ADTIVAVELDTYPNTDIGDPNYQHIGINIKSIRSKATTRWNVQDGKVGTAHISYNSVAKRLSAIVSYPGGSSATVSYDVDLNNILPEWVRVGLSASTGVYKETNTILSWSFTSKLKTNSTADAQSLHFTFNQFSQSPKDLILQGDASTDSDGNLQLTRVSNGSPQSNSVGRALYYAPVHVWDKSAVVASFDATFTFLIKSPDSDPADGIAFFIANTDSSIPHGSGGRLLGLFPDAN

SEQ ID NO: 136 - protein, 237 aa, Dioclea violacea
ADTIVAVELDSYPNTDIGDPNYPHIGIDIKSIRSKSTARWNMQTGKVGTVHISYNSVAKRLSAVVSYSGSSSTTVSYDVDLNNVLPEWVRVGLSATTGLYKETNTILSWSFTSKLKTNSAADENSLHFSFHKFSQNPKDLILQGDAFTDSDGNLELTKVSSSGDPQGNSVGRALFYAPVHIWEKSAVVASFDATFTFLIKSPDREPADGITFFIANTDTSIPSGSGGRLLGLFPDAN

SEQ ID NO: 137 - protein, 237 aa, Dioclea wilsonii
ADTIVAVELDSYPNTDIGDPNYPHIGIDIKSIRSKSTARWNMQTGKVGTVHISYNSVAKRLSAVVSYSGSSSTTVSYDVDLNNVLPEWVRVGLSATTGLYKETNTILSWSFTSKLKTNSIADENSLHFSFHKFSQNPKDLILQGDAFTDSDGNLELTKVSNSGDPQGNSVGRALFYAPVHIWEKSAVVASFDATFTFLIKSPDREPADGITFFIANTDTSIPSGSGGRLLGLFPDAN

SEQ ID NO: 138 - protein, 237 aa, Dioclea sclerocarpa
ADTIVAVELDSYPNTDIGDPNYPHIGIDIKSIRSKSTARWNMQTGKVGTVHISYNSVAKRLSAVVSYSGSSSTTVSYDVDLNNVLPEWVRVGLSATTGLYKETNTILSWSFTSKLKTNSIADENSLHFSFHKFSQNPKDLILQGDAFTDSDGNLQLTKVSSSGDPQGNSVGRALFYAPVHIWEKSAVVASFDATFTFLIKSPDREPADGITFFIANTDTSIPSGSGGRLLGLFPDAN

SEQ ID NO: 139 - protein, 237 aa, Dioclea reflexa
ADTIVAVELDSYPNTDIGDPNYPHIGIDIKSVRSKSTARWNMQTGKVGTVHISYNSVSKRLSAVVSYSGSSSTTVSYDVDLNNVLPEWVRVGLSATTGLYKQTNTILSWSFTSKLKTNSIADENSLHFSFHKFSQNPKDLILQGDASTDSDGNLQLTKVSSSGDPQGNSVGRALFYAPVHIWEKSAVVASFDATFTFLIKSPDREPADGITFFIANTDTTIPSGSGGRLLGLFPDAN

SEQ ID NO: 140 - protein, 236 aa, Cratylia argentea
ADTIVAVELDTYPNTDIGDPNYQHIGINIKSIRSKATTRWNVQDGKVGTAHISYNSVAKRLSAIVSYPGGSSATVSYDVDLNNILPEWVRVGLSASTGLYKETNTILSWSFTSKLKTNSTADAQSLHFTFNQFSQNPKDLILQGDASTDSDGNLQLTRVSNGSPQSNSVGRALYYAPVHVWDKSAVVASFDATFTFLIKSTDSDIADGIAWFIANTDSSIPHGSGGRLLGLFPDAN

SEQ ID NO: 141 - protein, 234 aa, Cratylia mollis
ADTIVAVELDTYPNTDIGDPSYQHIGINIKSIRSKATTRWDVQNGKVGTAHISYNSVAKRLSAVVSYPGGSSATVSYDVDLNNILPEWVRVGLSASTGLYKETNTILSWSFTSKSNSTADAQSLHFTFNQFSQSPKDLILQGDASTDSDGNLQLTRVSNGSPQSDSVGRALYYAPVHIWDKSAVVASFDATFTFLIKSPDREIADGIAFFIANTDSSIPHGSGGRLLGLFPDAN

SEQ ID NO: 142 - protein, 290 aa, Canavalia gladiata
MAISKKSSLFLPIFTFITMFLMVVNKVSSSTHETNALHFMFNQFSKDQKDLILQGDATTGTDGNLELTRVSSNGSPQGSSVGRALFYAPVHIWESSAVVASFDATFTFLIKSPDSHPADGIAFFISNIDSSIPSGSTGRLLGLFPDANVIRNSTTIDFNAAYNADTIVAVELDTYPNTDIGDPNYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNEIPDIATVV

SEQ ID NO: 143 - protein, 290 aa, Canavalia rosea
MAISKKSSLFLPIFTFITMFLMVVNKVSSSTHETNALHFMFNQFSKDQKDLILQGDATTGTDGNLELTRVSSNGSPQGNSVGRALFYAPVHIWESSAVVASFDATFTFLIKSSDSHPADGIAFFISNIDSSIPSGSTGRLLGLFPDANVIRNSTTIDFNAAYNADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNEIPDIATVV

SEQ ID NO: 144 - protein, 290 aa, Canavalia cathartica
MAISKKSSLFLPIFTFITMFLMVVNKVSSSTHETNALHFVFNQFSKDQKDLILQGDATTGTDGNLELTRVSSNGSPQGNSVGRALFYAPVHIWESSAVVASFDATFTFLIKSSDSHPADGIAFFISNIDSSIPSGSTGRLLGLFPDANVIRNSTTIDFNAAYNADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNEIPDIATVV

SEQ ID NO: 145 - protein, 290 aa, Canavalia brasiliensis
MAISKKSSLFLPIFTFITMFLMVVNKVSSSTHETNALHFMFNQFSKDQKDLILQGDATTGTDGNLELTRVSSNGSPQGSSVGRALFYAPVHIWESSAVVASFEATFTFLIKSPDSHPADGIAFFISNIDSSIPSGSTGRLLGLFPDANVIRNSTTIDFNAAYNADTIVAVELDTYPNTDIGDPSYPHIGIDIKSVRSKKTAKWNMQNGKVGTAHIIYNSVGKRLSAVVSYPNGDSATVSYDVDLDNVLPEWVRVGLSASTGLYKETNTILSWSFTSKLKSNEIPDIATVV

SEQ ID NO: 146 - protein, 290 aa, Canavalia ensiformis
MAISKKSSLFLPIFTFITMFLMVVNKVSSSTHETNALHFMFNQFSKDQKDLILQGDATTGTDGNLELTRVSSNGSPQGSSVGRALFYAPVHIWESSAVVASFEATFTFLIKSPDSHPADGIAFFISNIDSSIPSGSTGRLLGLFPDANVIRNSTTIDFNAAYNADTIVAVELDTYPNTDIGDPSYPHIGIDIKSVRSKKTAKWNMQNGKVGTAHIIYNSVDKRLSAVVSYPNADSATVSYDVDLDNVLPEWVRVGLSASTGLYKETNTILSWSFTSKLKSNEIPDIATVV

SEQ ID NO: 147 - protein, 290 aa, Canavalia ensiformis; identical to SEQ ID NO: 146

SEQ ID NO: 148 - protein, 281 aa, Canavalia bonariensis
MAISKKSSLYLPIFTFITMLLMVVNKVSSSTADANALHFTFNQFSKDQKDLILQGDATTGTDGNLELTRVSSNGSPQGNSVGRALFYAPVHIWESSAVVASFDATFKFLIKSPDSEPADGITFFIANIDSSIPSGSGGRLLGLFPDANIIKNSTTIDFNAAYNADTIVAVELDTYPNTDIGDPNYPHIGIDIKSIRSKKTTRWNIQNGKVGTAHINYNSVGKRLSAIVSYPNSDSATVSYDVDLDNVLPEWVRVGLSATTGLYKETNTILSWSFTSKLKSN

SEQ ID NO: 149 - protein, 291 aa, Dioclea lasiophylla
MGISKKSQLVPLLAFITMFLMVVSRVSSSIADANSLHFSFSQFSQNPKDLILQGDATTDSDGNLQLTRVSSDGSPQGSSVGRALFYAPVHIWEKSAVVASFDATFTFLIKSPDRDPADGITFFIANTDTSIPSGSGGRLLGLFPDANIIKNSTNLDFNAAYNADTIVAVELDSYPNTDIGDPSYPHIGIDIKSIRSKSTARWNMQTGKVGTAHISYNSVAKRLSAVVSYSGTSSTTVSYDVDLNNVLPEWVRVGLSATTGLYKETNTILSWSFTSKLKTNQLQDLRIASVV

SEQ ID NO: 150 - protein, 291 aa, Dioclea guianensis
MGISKKSQLVPLLAFITMFLIVVSRVSSSIADANSLHFSFSQFSQNPKDLILQGDATTDSDGNLQLTRVSSDGSPQGSSVGRALFYAPVHIWEKSAVVASFDATFTFLIKSPDRDPADGITFFIANTDTSIPSGSGGRLLGLFPDANIIKNSTNLDFNAAYNADTIVAVELDSYPNTDIGDPSYPHIGIDIKSIRSKSTARWNMQTGKVGTAHISYNSVAKRLSAVVSYSGTSSTTVSYDVDLNNVLPEWVRVGLSATTGLYKETNTILSWSFTSKLKTNQLQDLRIASVV

SEQ ID NO: 151 - protein, 261 aa, Dioclea grandiflora
LIVVSRVSSSIADENSLHFSFHKFSQNPKDLILQGDAFTDSDGNLQLTKVSSSGDPQGNSVGRALFYAPVHIWEKSAVVASFDATFTFLIKSPDREPADGITFFIANTDTSIPSGSGGRLLGLFPDANIVKNSTTLDFNAAYNADTIVAVELDSYPNTDIGDPNYPHIGIDIKSIRSKSTARWNMQTGKVGTVHISYNSVAKRLSAVVSYSGSSSTTVSYDVDLNNVLPEWVRVGLSATTGLYKETNTILSWSFTSKLKTN

SEQ ID NO: 152 - protein, 459 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAHKKLTVHVSTYLHSQPDTLTYDVDLSTKLPEKVKIGISASTGQFSQTTEILSWIFKSLASHFISKNHKIIAMGVSFNLHKFDPKHSKEIQFQGDATITDHHIIRLTNLDDDGNPLGNRVGRVLFSDPVHLYDHSGLRAGFETTFVIKTITTAKITYNSAYKKLTVHVSTYLHSQPDTLTYDVDLSTKLPEKVKIGISASTGQFSQTTEILSWIFKQDCPLLLFVFGFGFLSYVIYAWMLTLFSSFLPLFLPSVFSKAMHVKNNDLSNIFCILFLLIITCYTTY

SEQ ID NO: 153 - protein, 541 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAHKKLTVHVSTYLHSQPDTLTYDVDLSTKLPEKVKIGISASTGQFSQTTEILSWIFKSLASHFISKNHKIIAMGVSFNLHKFDPKHSKEIQFQGDATITDHHIIRLTNLDDDGNPLGNRVGRVLFSDPVHLYDHSGLRAGFETTFHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAHKKLTVHVSTYLHSQPDTLTYDVDLSTKLPEKVKIGISASTGQFSQTTEILSWIFKSN

SEQ ID NO: 154 - protein, 297 aa, Vigna radiata
MAVSSTNYSFLIAVFAFVTMLLMFPNKVKSAQSLSFSFSRFGPDHKDLIFQGDAISTNNVLQLTKLDSAGNPLSGSVGRVLYSAPLHLWENSAVVSSFETSFTFQISTPYTSPPADGVAFFLAPYDTVIPSNSGGSLLGLFSNLNALRNSSTSQNQTILDFKAVSNKVVAVEFDTYPNENIGDPAYKHIGIDVNSIRSKTTARWNWQNGKTATAHISYNSASKRLTVSTFYPGSNPVTLSYDVELHTVLSEWVRVGFSASSGEQKERNTILSWSFTSSLKNNEVKDEKQDMFIKTVV

SEQ ID NO: 155 - protein, 297 aa, Vigna unguiculata
MAISDKNNPFIIPLLAFMTMLCMFPGKVKSAESLSFSFSKFGSDQKDLIFQGDAISTNNVLQLTKLNSAGNPVGVSVGRVLYSAPLRLWGDSAVLSSFDTTATFQISTPYVSYADGIAFFLAPHDTVIPPNSNGRLLGLFSNNINAFKNSSTSVNKTTVDFKAATNNVVAVEFDTYPNVDFGDPPYIHVGIDVNSIISKATARWNWQNGKTATVHITYNSASKRLTASIYYPGGTPVTVSYDVQLQTVLPQWVRVGWSASTGAEAQRNTLLSWSFSSSLKNNDVKEEKEDTFITTVV

SEQ ID NO: 156 - protein, 205 aa, Glycine soja
MKAPRLFQALKPPLPLPSQQLTLLQLLEFPSSLHDSTIPPHSGGRLLGLFPDSNALKNSSSSNNETAIDFKASSDKVVAVEFDTYHNWDSWDPYYKHIGIDVNSIRSKATAQRNWQNGKIATAHISYNSASKRLTVVAFYPATKAVTLSHDIELNKVLPEWVRVGISASTGAHKQKNTILSWSFTSSLKNNGVQKKEDMYIASVA

SEQ ID NO: 157 - protein, 297 aa, Vigna unguiculata
MAISTTNYSVLIPMFVFVTTLFMFPSKVKSAQSLSFSFSRFGSDQKDLIFQGDAISTNNVLQLTKLDSAGNPVSGSVGRVLYSAPVPIWENSAVVYSFESSFTYEISTPYTSPPADGLTFFIAPYDTVIPPNSGGRLIGLFTDSNAFRNSSISKNQTTVDFKAESNKVVAVEMDTYSNDNVGDPSYKHIGIDVNSIRSKTTARWDWQNGKTATAHISYNSASKRLTVATFYPGSSAVTLSYDLELHTVLSKWVRVGFSASTGEQKQRNTILSWSFTSSLKNNEVKEEKQDILITTVV

SEQ ID NO: 158 - protein, 272 aa, Lablab purpureus
MFPSKVKSAQSLSFSFTKFDPNQEDLIFQGHATSTNNVLQVTKLDSAGNPVSSSAGRVLYSAPLRLWEDSAVLTSFDTIINFEISTPYTSRIADGLAFFIAPPDSVISYHGGFLGLFPNANTLNNSSTSENQTTTKAASSNVVAVEFDTYLNPDYGDPNYIHIGIDVNSIRSKVTAKWDWQNGKIATAHISYNSVSKRLSVTSYYAGSKPATLSYDIELHTVLPEWVRVGLSASTGQDKERNTVHSWSFTSSLWTNVAKKENENKYITRGVL

SEQ ID NO: 159 - protein, 243 aa, Glycine max
MLFMLPNKVNSAHSVSFTFNKLGGDQKDLIFQGDATSNNNVLQLTKLDNKGNPVSGSQLTLLQLLEFPSSLHDSTIPPHSGGRLLGLFPDSNALKNSSSSNNETAIDFKASSDKVVAVEFDTYHNWDSWDPYYKHIGIDVNSIRSKATAQRNWQNGKIATAHISYNSASKRLTVVAFYPATKAVTLSHDIELNKVLPEWVRVGISASTGAHKQKNTILSWSFTSSLKNNGVQKKEDMYIASVA

SEQ ID NO: 160 - protein, 274 aa, Apios americana
MAFSKNKSLSLLPLLAFISMFLMLLKRVNSADSLSFSFKEFTADPEDLIFQGDTITGSNNVLQLTKVDSSGNPVGQSVGRVLYYAPVHLWESSELVSSFETTFTFSISSSVTNPGDGLAFFIASPDTTIPSKSSGENLGLFPSSSALVAVEFDTYPNNNVGDPSYKHIGIDINSITSKTTTKWNWQNGATATAQISYNSASKRLSVVASYPGTTPVTLSYDTDLLAILPQWVRVGFSASTGQQMQSNTLHSWSFTSTLQTNNQIQNKDMHLASI

SEQ ID NO: 161 - protein, 240 aa, Leucomphalos mildbraedii
ANSVCFTFTDFESGQQDLIFQGDASVGSNKALQLTKVDSKGNPQGGSVGRALYTAPIRLWQSSSLVASFETTFTFSISQGSSTPAAALTFFIASPDTKIPSGSGGRLLGLFGSSNNAGSDNGVVAVEFDTYPNTDIGDPNYRHIGIDVNSIRSKAASKWDWQNGKTATAHISYNSASKRLSVVSSYPNSSPVVVSFDVELNNVGPPDVRVGFSATTGQYTQTNNILAWSFRSSLMGYQAN

SEQ ID NO: 162 - protein, 500 aa, Arachis hypogaea
MKPFCVFLTFFLLLAASSKKVNSAETVSFNFNSFSEGNPAINFQGDVTVLSNGNIQLTNLNKVNSVGRVLYAMPVRIWSSATGNVASFLTSFSFEMKDIKDYDPADGIIFFIAPEDTQIPAGSIGGGTLGVSDTKGAGHFVGVEFDTYSNSEYNDPPTDHVGIDVNSVDSVKTVPWNSVSGAVVQVTVIYDSSTKTLSVAVTNENGDITTIAQVVDLKAKLPERVKFGFSASGSLGGRQIHLILASKKVNSASETETVSFSFNSFAQGNPAINLQGDATVHSDGNVQLTNLKNSYSAGRVLYATPVRLWDKATGNVASFVTSFSFQMTDLEGYNAADGIIFFVAPEDTQIPSGGVGGTLGVASSNGVGKFVGVEFDSYSNSEFKDPPYQHIGIDVNTLVSSKTVEWKRVSGSVVKVTVIYDSPSKTLSVAVINESGDINTITEVVDLKAELPEKVKFGFSSASSVGGRQIHLIRSWSFISTLKTTTSISSNGKTMDIATA

SEQ ID NO: 163 - protein, 235 aa, Glycine max
MGLWNTTNAVSCRFHKFGDDQKNLVFQGDATSSSRGIELTKLDGGGKPVGGSVGRVLYSSPVHLWESSTVVASFETDFTFSISSDSTTPGDGLAFFIAPFDTKIPPNSGGSNLGLFPSDNVVAVEFDTYPNRDKGDPDYRHIGIDVNSIVSKATARWEWQNGKIATVHISYNSASKRLTVAAFYPGTQTVTLSHDIELNKVLPEWVRVGLSASTGQQKQTNTIHSWSLAFNNSIG

SEQ ID NO: 164 - protein, 235 aa, Glycine soja
MGLWNTTNAVSCRFHKFGDDQKNLVFQGDATSSSRGIELTKLDGGGKPVGGSVGRVLYSSPVHLWESSTVVASFETDFTFSISSDSTTPGDGLAFFIAPFDTKIPPNSGGSNLGLFPSDNVVAVEFDTYPNRDKGDPDYRHIGIDVNSIVSKATARWEWQNGKIATVHISYNSASKRLTVAAFYPGTQTVTLSHDIELNKVLPEWVRVGLSASTGQQKQTNTIHSWSLAFNNRIG

SEQ ID NO: 165 - protein, 529 aa, Arachis hypogaea
MKPFCVFLTFFLLLAASSKKVNSAETVSFNFNSFSEGNPAINFQGDVTVLSNGNIQLTNLNKVNSVGRVLYAMPVRIWSSATGNVASFLTSFSFEMKDIKDYDPADGIIFFIAPEDTQIPAGSIGGGTLGVSDTKGAGHFVGVEFDTYSNSEYNDPPTDHVGIDVNSVDSVKTVPWNSVSGAVVQVTVIYDSSTKTLSVAVTNENGDITTIAQVVDLKAKLPERVKFGFSASGSLGGRQIHLILASKKVNSASETETVSFSFNSFAQGNPAINLQGDATVLSDGNVQLTNLKNSYSAGRVLYATPVRLWDKATGNVASFVTSFSFQLTDLEGYNAADGIIFFVAPEDTQIPSGGVGGTLGVASSNGVGQFVGVEFDSYSNSEFKDPPYQHVGIDVNTLVSSKTVEWKRVSGSVVKVTVIYDSPSKTLSVAVINESGDINTITEVVDLKAKLPEKTLSVAVINESGDINTITEVVDLKAELPEKVKFGFSSASSVGGRQIHLIRSWSFISTLKTTTSISSNGKTMDIATA

SEQ ID NO: 166 - protein, 239 aa, Arachis hypogaea
MSSTSFTFNKFEFNNEKDLIFQGDASISKNNVLNLTKVDQNGLPLGTSVGRVLYSAPIHLFSSSALASSFETTFTFRISSNNSNNVGDGLAFFIAAPETTIPPGSNGRLLGLFSGPYTTDKVVAVEFDTYPNRDIGDPDFTHIGIDINTLKSSAVGKWSVQSGAIATAYISYDSVSKILSVISSYPNAAPVTVTHAFDLDKTLPEWVRVGFSGSTGLFSQTNDILSWSFRSTLTTNNIV

SEQ ID NO: 167 - protein, 239 aa, Arachis hypogaea
MSSTSFTFNKFEFNNEKDLIFQGDASISKNNVLNLTKVDQNGLPLGTSVGRVLYSAPIHLFSSSALASSFETTFTFRISSNNSNNVGDGLAFFIAAPETTIPPGSNGRLLGLFSGPYTTDKVVAVEFDTYPNRDIGDPDFTHIGIDINTLKSSAVGKWSVQSGAIATAYISYDSVSKILSVTCSYPNAAPVTVTHAFDLDKTLPEWVRVGFSGSTGLFSQTNDILSWSFRSTLTTNNIV

SEQ ID NO: 168 - protein, 275 aa, Phaseolus vulgaris
MFFIMFPSKVNSAQSLSFNFTKFDLDQKDLIFQGDATSTNNVLQLTKLDSGGNPVGASVGRVLFSAPFHLWENSMAVSSFETNLTIQISTPHPYYAADGFAFFLAPHDTVIPPNSWGKFLGLYSNVFRNSPTSENQSFGDVNTDSRVVAVEFDTFPNANIDPNYRHIGIDVNSIKSKETARWEWQNGKTATARISYNSASKKLTVTTFYPGMEVVTLSHDVDLHAELPEWVRVGLSASTGEEKQKNTIISWSFTSSLKNNEVKEPKEDMYIANVV

SEQ ID NO: 169 - protein, 237 aa, Lablab purpureus
AQSLSFSFTKFDPNQEDLIFQGTATSKLDSAGNPVSSSAGRVLYSAPLRLWEDSAVLTSFDPTIYIFTNYTSRIADGLAFIAPPDSVISYHGGFLGLFPNAAESGIAESNVVAVEFDTDYLNPDYGDPNYIHIGIDVNSIRSKVTASWDWQNGKIATAHISYNSVSKRLSVTTYYPGRGKPATSYDIELHTVLPEWVRVGLSASTGQNIERNTVHSWSFTSSLWTNVAKVGVASISG

SEQ ID NO: 170 - protein, 299 aa, Phaseolus vulgaris
MAISNNKPSFLIPQLVFVTMLLIMFPSEVNSAESLSFSFTKFGPDQKDLIFQGDATSTNNVLQLTKLDNEGNPVSGSVGRVLYSGPFHLWENSAALSSFETTFTIQISTPYTSPPADGFAFFLAPHDTVIPPNSGGSLLGLFSDLNAFKNSSTTSQNQTLFDVKAASNKVVAVEFDTYPNENVGDPRYRHIGIDVNSIRSKATARWEWYNGKTASARISYNSASKKLTVATFYPGIKALTLSHDVDLHAELPEWVRVGFSASTGEQKERNTILSWSFKSSLEKNEVNEEKEDIYITSVV

SEQ ID NO: 171 - protein, 305 aa, Glycine soja
MAIWKTNKSLSLPLMAFTMATMFLMLLNRVNSADSLSFSFNNFSEDQEDLILQGDATTGASSENDKNVLQLTKLDDSGKPEFGSVGRVLYFAPVHLWKSSQLVSTFETTFTFKISSASPDSVPADGLAFFIASPDTTPGAGGQDLGLFPHLTSLKNSSSSHHRKVTRITGVKDLASEPVVAVEFDTFINTDIGDPEYQHIGIDINSITSVTTTKWDWQNGKTVTAQISYNSASKRLTVVASYPDSTPVSLYYDIDLFTILPEWVRVGFSASTGGAAEANTLLSWSFSSSLQTNQIQKEDMHGIVM

SEQ ID NO: 172 - protein, 305 aa, Glycine max
MAIWKTNKSLSLPLMAFTMATMFLMLLNRVNSADSLSFSFNNFSEDQEDLILQGDATTGASSENDKNVLQLTKLDDSGKPEFGSVGRVLYFAPVHLWKSSQLVSTFETTFTFKISSASPDSVPADGLAFFIASPGTTPGAGGQDLGLFPHLTSLKNSSSSHHRKVTRITGVKDLASEPLVAVEFDTFINTDIGDPEYQHIGIDINSITSVTTTKWDWQNGKTVTAQISYNSASKRLTVVASYPDSTPVSLYYDIDLFTILPEWVRVGFSASTGGAAEANTLLSWSFSSSLQTNQIQKEDMHGIVM

SEQ ID NO: 173 - protein, 239 aa, Arachis hypogaea
MSSVSFTFNKFEPNQEDLILQGDSSISNKNVLHLTNVDQNGLPQNGSVGRALYSAPIHIFSKSALASSFETTFTFKVSQNGSNAPGDGFAFFIAPTDTTIPPNSGGKFLGLFDGPGIITDTIVAVEFDTYVNREIEDPDFIHIGIDINSIKSSVTNKWILQSGVVATAKISYNSVSKRLSVICSYPNAAPVTLTHDVDFSNAVPEWVRVGFSGSTGQYAQANDILSWSFRSTLTTNNIV

SEQ ID NO: 174 - protein, 327 aa, Phaseolus vulgaris
MEVSEKKYNFFPINREGFAWTYQDSNFIAFNTTMAISTNKPSFLIPLLVFVTMFFIMFPSKVNSAQSLSFNFTKFDLDQKDLIFQGDATSTNNVLQLTKLDSGGNPVGASVGRVLFSAPFHLWENSMAVSSFETNLTIQISTPHPYYAADGFAFFLAPHDTVIPPNSWGKFLGLYSNVFRNSPTSENQSFGDVNTDSRVVAVEFDTFPNANIDPNYRHIGIDVNSIKSKETARWEWQNGKTATARISYNSASKKLTVTTFYPGMEVVTLSHDVDLHAELPEWVRVGLSASTGEEKQKNTIISWSFTSSLKNNEVKEPKEDMYIANVV

SEQ ID NO: 175 - protein, 294 aa, Vigna unguiculata
MAISNKSYSFLIPLFVSVTMFFMFPGKVKSSQSLAFSFSKFGPDQKDLIFQGDAISTNNVIQLTKLDSAGNPLRGSVGRVLHSSPMRLWENSTAVSSFESFFTFQISTPYTSPPADGLAFFFAPYETVIPSNSAGSHLGLFSNNINNALRNSSTSRNQTTVGFKDVSNNVVNNVGNNVVAVEFDTYPNPDIGDPANKHIGIDVNSITSKVTTRWDWQNGKTATAYISYNSAAKRLTVATFYAGSNTVILSYDVELNTVLPQWVRVGFSGSTGGETQRNTILSWSFTSSLKNNEA

SEQ ID NO: 176 - protein, 278 aa, Arachis hypogaea
MSSVSFTFNKFEPNQEDLILQGDSSISNKNVLHLTNVDQNGLPQNGSVGRALYSAPIHIFSKSALASSFETTFTFKVSQNGSNAPGDGFAFFIAPTDTTIPPNSGGKFLGLFDGPGITTDTIVAVEFDTYVNRDIEDPDFIHIGIDINSIKSSVTNRWIVQSGVVATAKISYNSVSKTLSVICSYPNAAPVTLTHNVDLNNVLPEWVRVGFSGSTGQYAQANDILSWSFRSTLTTNNIGIWVSFKLFTPVQQIMIQRYAGHFLTKSFIHLGAILGRSL

SEQ ID NO: 177 - protein, 235 aa, Glycine max
MGLWNTTNAVSCRFHKFGDDQKNLVFQGDATSSSRGIELTKLDGGGKPVGGSVGRVLYSSPVHLWESSTVVASFETDFTFSISSDSTTPGDGLAFFTAPFDTKIPPNSGGSNLGLFPSDNVVAVEFDTCPNRDKGDPDYRHIGIDVNSIVSKATARWEWQNGKIATVHISYNSASKRLTVAAFYPGTQTVTLSHDIELNKVPPEWVRVGLSASTGQQKQTNTIHSWSLAFNNSIG

SEQ ID NO: 178 - protein, 279 aa, Phaseolus vulgaris
AQSLSFNFTKFDLDQKDLIFQGDATSTNNVLQLTKLDSGGNPVGASVGRVLFSAPFHLWENSMAVSSFETNLTIQISTPHPYYAADGFAFFLAPHDTVIPPNSWGKFLGLYSNVFRNSPTSENQSFGDVNTDSRVVAVEFDTFPNANIDPNYRHIGIDVNSIKSKETARWEWQNGKTATARISYNSASKKSTVTTFYPGMEVVALSHDVDLHAELPEWVRVGLSASTGEEKQKNTIISWSFTSSLKNNEVKEPKEDMYIANVVRSYTWINDVLSYISNK

SEQ ID NO: 179 - protein, 1109 aa, Arachis hypogaea
MSLYKSKPVFLILIPLLMLHRNLRTSFEFSDFSSPYRNELFIFQGDASASSNGSIQLTKIVNGKPIPNSVGRVSYGLPVRLWDLKTQKLASFTTSFSFLVSPNGGDGISFFMAPFHSPIPKDSQGGYLGLFNPDASLAPFRDPTVAVEFDTFSNPWDPAFSHIGIDVNSIVSVTSVPWLNGVEGLNTTVFATVSYEAVAQNLSVVVSYYSGSVLGGTTVNASLSHVIDLRNVLPERVSVGFSGATGQFVEVNNILSWKFTSFTFPNFWSPTKDIVFEGDADYSNGGLTLTKIVNSAPIGNSAGRASYSSPVRLWDANTGSLAAFTTTFSFTVEPFLYKPFGDGIAFFIAPFVSELPKNSSGGYLGLFNADTALDSYKNQIVGVEFDSFSNAWDPNTAHIGIDVNSIASVTTTPWQPGNVASATLDFEPVNTNLSVSVRYVNGSSSSISFVIDLRTVLPEWVRVGFSESVSFNLDNFMPNLYLIKFEGDAFVSEKVLQLTKNRIDGPITKSVGRASFDQPVKLWDKGTRQLTDFTTHFSFIMKAINPNMFGDGLSFYIAPFESTIPNNSVGGFLGLFSGESAFNTTANQIVAVEFDSFENPWDPNPNHVGINVNSIISVANVSWNRNMKNGSIANAWVSYNSTTKNLSVFLTYADNPTFNGTFSLSHVIDLREFLPEFVRIGFSAATGDWIEIHNVLSWSFNSTLDSSTGKSKVGLASGLSVGFGTLACLIGVICFVFWRKRRNRARKDEDDTGFDASIEDEFERGTGPKRFTQKELSQATNGFAEEGKLGEGGFGGVYKGAVGNPRMEVAVKRVSKGSKQGKKEYISEVRVISRLRHRNLVQLIGWCHEKGEFLLVYEYMPNGSLDSHLFGKGVMLAWAVRYKIALGLASALVYLHEEWEQCVVHRDIKSSNVMLDANFNAKLGDFGLARLVDHELGTQTTVLAGTMGYLAPECVTTGKSSKESDVYSFGAVALEIACGRRPVQVKEEPGKVRLIEWVWNLYGQGKLLEAADWRLDLEFDVKQMECLMTVGLWCCHPDYAMRPSIKQVINVLNFEAPLPSLPSQLPVPMYFAPPMEMCKFTYTSSGTTATSKDSSNYSSMSAGSRKSLL

SEQ ID NO: 180 - protein, 911 aa, Glycine soja
MAFTMATMFLMLLNRVNSADSLSFSFNNFSEDQEDLILQGDATTGASSENDKNVLQLTKLDDSGKPEFGSVGRVLYFAPVHLWKSSQLVSTFETTFTFKISSASPDSVPADGLAFFIASPDTTPGAGGQDLGLFPHLTSLKNSSSSHHRKVTRITGVKDLASEPVVAVEFDTFINTDIGDPEYQHIGIDINSITSVTTTKWDWQNGKTVTAQISYNSASKRLTVVASYPDSTPVSLYYDIDLFTILPEWVRVGFSASTGGAAEANTLLSWSFSSSLQTNQIQKEDMHGLYVRDMLSKVVPATFYTISSFSKLIWRSEQSSPKKSPIYSRSSTPPGKFTLVSTPVTLCRKACCLACYEILVSYRKYFATYVETCFQKFGDRVKHWITFNEPHTFSTQGYDVGLQAPGGSPFSFTCSASKPYIVAHNGGSLGVAFDVIWYEPLTNTKENNIDAAQKAQHFQLGCSSGGYIHLVVQREQGYIPCGSLLVKVFTRLKEISRTGGCLGTGCRHSLGKFDAKAYEGIFLGYSLHSKAFRIYNKRTMTIEESIHVSFDETNITSSREEFPDDITYSLEDMHYQERDLKRKRNGENKDAQDNIIQENDDLPKEWRTSRNHHLDNIIGDISKGITTRLSLKDLCNNMTFVSLIEPKNLKEAIIDDHWIVAIEFEMFMMGELNYFLGLQIKQTNDGIFVNQAKYCKELIKRFGMEKSKHLATPMSTSCYLDQDESDQPVDAKQYRGYSDSDFAGSKTDRKSTSGTCQFIGSALVSWNSKKQNSVALSTTEEEYISAALLPQIHRGFVVPRLNNFHETLHLSLEALLSSPTLFARLVSPSPPMFFSVSPTDVATSLVFSAPFLILSAIVHATSLALSFVSKQVQVLKDQVSEKVLSSNLVDTIVHIKRPVILNYWQGSSSTL

SEQ ID NO: 181 - protein, 239 aa, Cymbosema roseum
SGAVHFSFTKFSTSSSDLTLQGSALVSSKGSLKKNPSKKGKPVDHSVGRALYRSPIHIWDETTGKVASFDATFSFVSEAPAIPMLFPSSKGELNDEDDTRIGGQLGVVNDSYNVIRVTVAVENDGYRNRVDPSARPHISLPIKSVRSKKTAKWNMQTGKVGTAHISYNSVAKRLSAVVSYTGNSSSTTVSYDVLLNLAVLPSKVLVGKTATGLYKDHVETNTILSWSFTSKLKTNSIAD

SEQ ID NO: 182 - protein, 293 aa, Styphnolobium japonicum
MAISNTNFLQTKKPLFLPILAFITIFLMLLNRVNSSDSLSFTYENFQPNPEDLILQRDASITSNETLLLTRTSNGKPQKGSVGRALYYAPVRLWDKSTGRLASFETSFSFVITSPTTDPGDGIAFFIAPPDTTPGYTGGLLGLFNSSTVQSNSSDHGVAFHNSLPQIVAVEFDTYINGGRDPNYRHVGIDVNSIKSVSTTKWTWRNGVEATANISYNPVSQRLTAVSSYPNSEPITVHYDIDLKTVLPEWVRVGFSASTGENVEINSILSWSFSSSLQSLTAEKEDMYIARYV

SEQ ID NO: 183 - protein, 266 aa, Styphnolobium japonicum
LVFITFFLTLLNMVNSSDSLSFTFNNFGPDQRDLILQGDAHIPSGTLQLTKTDSSGVGRALYYLPVHLWDSRRGRLASFETSFSFVITSQGTDDPGDGIAFFIAPPETTIPPRSSGGFLGLFSPETALNSSLNPVVAVEFDTFINEDWDPSYWHIGIDVNSIKSSAAARWERKSGRKFTAHISYNSSSKKLSVVSSYPNTNCLVRVDYTVSYDIDLTTVLPEWVRIGFSASTGYKIEEHSILSWSFSSSFQSSRAKKEDLYIARCA

SEQ ID NO: 184 - protein, 290 aa, Arachis hypogaea
MASNSKIPLYLPLLASMAIFLILLHSVNSVDVTTFLFDRFDQNNENLIIQGDASVSSNGALQLTRVDSSGVPQGGSVGRALYSEPISLYDKSTGAVASIFTSFIFLISSPSDTPGDGLTFFLASPDTTIPPNSGGGYLGLFSASNALNNTRKELVGFKSTSDKVVAVEFDTYPNLNLGDPDYKHIGIDVNSIKSEVTAEWDFQNGEPVAVTIFYDPYAKTLRVFASYPNGYNVDFTHDIDLTTVLPEQVRVGFSGATGQYSQINNIISWSFGSILGKSFKVEKGGIASVV

SEQ ID NO: 185 - protein, 241 aa, Cajanus cajan
MLLMAVNRVNSADSLSFSFNSFGLDQKDLIFQGDATALRNALQLTRLDSQLQPLPSSVGRVLYSAPIQLVGAFETSFTFSISSPDTIPGDGLTFFIASHDTVIPPNSNGKVVAVEFDTYPNLDIRDPNFVHIGINVNSITSARTAQWVWRNGLTATARINYNSLTKTLTAATFYPGTGTEVVSISHAIDLSTVLPQWVRVGFSASTGQHKQKNSIHSWAFSTILKNSKIEEEEDTNIVSVV

SEQ ID NO: 186 - protein, 234 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAHKKLTVHVSTYLHSQPDTLTYDVDLSTKLPEKVKIGISASTGQFSQTTEILSWIFKSN

SEQ ID NO: 187 - protein, 234 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASAETEIPPESSGKFLGLFNDASDRIVAVEFDTFSNSDIGDPNYPHIGVDVNSIRSSKVCYWNFHDAAITTAKITYNSAHKKLTVHVSTYLHSQPDTLTYDVDLSTKLPEKVKIGISASTGQFSQTTEILSWIFKSN

SEQ ID NO: 188 - protein, 234 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNSEYTPGPGDGLAFFLASADTEIPPESSGKFLGLFNDASDRIVAVEFDTFSNSDIGDPNYPHIGVDVNSIRSSKVCYWNFHDAAITTAKITYNSAHKKLTVHVSTYLHSQPDTLTYDVDLSTKLPEKVKIGISASTGQFSQTTEILSWIFKSN

SEQ ID NO: 189 - protein, 234 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAYKKLTVHVSTYLHSQPDTLTYDVDLSTKLPEKVKIGISASTGQFSQTTEILSWIFKSN

SEQ ID NO: 190 - protein, 234 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGVDVNSIRSSKVCYWNFHDAAITTAKITYNSAHKKLTVHVSTYLHSQPDTLTYDVDLSTKLPEKVKIGISASTGQFSQTTEILSWIFKSN

SEQ ID NO: 191 - protein, 314 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAHKKLTVHVSTYLHSQPDTLTYDVDLSTKLPEKVKIGISASTGQFSQTTEILSWIFKSSKVCYWNFHDAAITTAKITYNSAHKKLTVHVSTYLHSQPDTLTYDVDLSTKLPEKVKIGISASTGQFSQTTEILSWIFKSN

SEQ ID NO: 192 - protein, 234 aa, Arachis hypogaea
MGVSFNLHKFAPTNSKEIKFQGDATITDHNVIRLTNLDSDGNPLGNRVGRVLFSDPVHLYDHSGFRAGFETTFVFRISKPYSSEFAPGPGDGLAFFLANADTEIPPESSGKFLGLFNDASDKIVAVEFDTFSNFEIGDPSYPHIGININSIRSSAVGYWNWHDGAVTTAKITYNSVLKRITVSVSTYLDNQPNTLSYDVDLSTKLPQKVAVGLSASTGQYSQNTEILSWTFKSN

SEQ ID NO: 193 - protein, 290 aa, Cladrastis kentukea
MAISNTNLLQTKKPISLPLLAFITLFLMLLNRVNSSDSLSFTFDNFRPDQRDLILQGDAKISSGGDSLQLTKTDTSGKPVRGSVGRALYYTPLHLWDSSTNRLASFQTTFTFVLSSPTNNPGDGIAFFIAPPETTIPPGSSGGLLGLFSPDNALNNSLNQIVAVEFDTFVNNNWDPSHRHIGIDVNTIKSSATVRWQRENGSLATAQISYNSDTKKLSVVSSYPNTQANEDYTVSYDVDLKTELPEWVRVGFSGSTGGYVQNHNILSWTFNSNLQSSRAKKEDIYIKRYV

SEQ ID NO: 194 - protein, 234 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAHKKLIVHVSTYLHSQPDTLTYDVDLSTKLPEKVKIGISASTGQFSQTTEILSWIFKSN

SEQ ID NO: 195 - protein, 234 aa, Arachis hypogaea
MGVSFNLHKFDPKHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGVDVNSIRSSKVCYWNFLDAVITTAKITYNSAHKKLTVHVSTYLHSQPDTLTYDVDLSTKLPEKVKIGISASTGQFSQTTEILSWIFKSN

SEQ ID NO: 196 - protein, 294 aa, Arachis hypogaea
MGVSFNLHKFDPKHSKEIQFQGDATITDHHIIRLTNLDDDGNPLGNRVGRVLFSDPVHLYDHSGLRAGFETTFHSKEIQFQGDATITDHHIIRLTNLDDDGNPLGNRVGRVLFSDPVHLYDHSGLRAGFETTFVFRISKPYNTEYTPGPGDGLAFFLASADTEIPPESSGKFLGLFNDASDRIVAVEFDTFSNSDIGDPNYPHIGIDVNSIRSSKVCYWNFHDAAITTAKITYNSAHKKLTVHVSTYLHSQPDTLTYDVDLSTKLPEKVKIGISASTGQFSQTTEILSWIFKSN

SEQ ID NO: 197 - protein, 261 aa, Arachis hypogaea
MSPLSSSTGSIKVTNENLIIQGDTSFSSNGALQLTRVDSSGVPQGGSVGRALYSEPISLYDKSTGRVASIFTSFIFLISSPSDTPGDGLTFFLASPDTTIPPNSGGGYLGLFSASNALNNTRKELVGFKSTSDKVVAVEFDTYPNLNLGDPDYKHIGIDVNSIKSEVTAEWDFQNGEPVAVTIFYDPNAKTLRVYASYRNGYNVDFTHDIDLTTVLPEQVRVGFSGATGQYSQINNIISWSFGSILGKSFKVEKGGIASVV

SEQ ID NO: 198 - protein, 234 aa, Arachis hypogaea
MGVSFNLHKFAPTNSKEIKFQGDATITDHNVIRLTNLDSDGNPLGNRVGRVLFSDPVHLYDHSGFRAGFETTFVFRISKPYSSEFAPGPGDGLAFFLANADTEIPPESSGKFLGLFNDASDKIVAVEFDTFSNLEIGDPSYPHIGININSIRSSAVGYWNWHDGAVTTAKITYNSALKRITVSVSTYLDNQPNTLSYDVDLSTKLPQKVAVGLSASTGQYSQNTEILSWTFKSN

SEQ ID NO: 199 - protein, 234 aa, Arachis hypogaea
MGVSFNLHKFAPTNSKEIKFQGDATITDHNVIRLTNLDSDGNPLGNRVGRVLFSDPVHLYDHSGFRAGFETTFVFRISKPYSSEFAPGPGDGLAFFLANADTEIPPESSGKFLGLFNDASDKIVAVEFDTFSNFEIGDPSYPHIGININSIRSSAVGYWNWHDGAVTTAKITYNSALKRITVSVSTYLDNQPNTLSYDVDLSTKLPQKVAVGLSASTGQYSQNTEILSWTFKSN

SEQ ID NO: 200 - protein, 234 aa, Arachis hypogaea
MGVSFNLHKFAPTNSKEIKFQGDATITDHNVIRLTNLDSDGNPLGNRVGRVLFSDPVHLYDHSGFRAGFETTFVFRISKPYSSEFAPGPGDGLAFFLANADTEIPPESSGKFLGLFNDASDKIVAVEFDTFSNFEIGDPSYPHIGININSIRSSAVGYWNWHDGAVTTAKITYNSALKRIAVSVSTYLDNQPNTLSYDVDLSTKLPQKVAVGLSASTGQYSQNTEILSWTFKSN

SEQ ID NO: 201 - protein, 234 aa, Arachis hypogaea
MGVSFNLHKFVPNNSKEIKFQGDATITDHNVIRLTNLDSDGNPLGNRVGRVLFSDPVHLYDHSGFRAGFETTFVFRISKPYNSEFAPGPGDGLAFFIANSNTEIPPESSGKFLGLFNDASDKIVAVEFDTFSNFEIGDPSYPHIGININSIRSSAVGYWNWHDGAVTTAKITYNSALKRITVSVSTYLDNQPDTLTYDVDLSTKLPEKVAVGLSASTGQYSQNTEILSWTFKSN

SEQ ID NO: 202 - protein, 293 aa, Cladrastis kentukea
MTISNTNFLETKKPLSLPLLAFITIYLMLLHRVNSSDSLSFTFNNFPPNSEDLIFQKDASISSNETLELTRISSSGQPATSSVGRALYYTPVRLWDKSTGRLASFKTTFSFAITSPTQDPGDGFAFFIAPPDTTPGYGGGLLGLFNGFNLRNSSNNGVAVNNQSAQIVAVEFDTYINGQCDPKYRHVGIDVNSITSLAYTQWQWQNGVKATAQISYNPASQKLTAVTSYPNSTPLTVSLDIDLQTVLPEWVRVGFSASTGQNVERNSILAWSFSSSLTTLTAKKEDMYIARYV

SEQ ID NO: 203 - protein, 234 aa, Arachis hypogaea
MGVSFNLHKFDPKHSKEIQFQGDATITDHHIIRLTNLDDEGNPLGNRVGRVLFSDPVHLYDHSGFRAGFETIFVFRISKPYNTDYTPGPGDGLAFFLASADTEIPPQSSGMFLGLFNDASDKIVAVEFDTFSNSEVGDPNYPHIGVDINSIRSSKVCYWNFHDAAITTAKITYNSAHKKLTVHVSTYLDTQPDTLTYDVDLSTKLPDKVKVGISASTGQFSQTTEILSWIFKSN

SEQ ID NO: 204 - protein, 234 aa, Arachis hypogaea
MGVSFNLHKFDPKHSKEIQFQGDATITDHHIIRLTNLDDEGNPLGNRVGRVLFSDPVHLYDHSGFRAGFETTFVFRISKPYNTDYTPGPGDGLAFFLASADTEIPPQSSGMFLGLFNDASDKIVAVEFDTFSNSEVGDPNYPHIGVDINSIRSSKVCYWNFHDAAITTAKITYNSAHKKLTVHVSTYLHTQPDTLTYDVDLSTKLPDKVKVGISASTGQFSQTTEILSWIFKSN

SEQ ID NO: 205 - protein, 234 aa, Arachis hypogaea
MGVSFNLHKFDPKHSKEIQFQGDATITDHHIIRLTNLDDEGNPLGNRVGRVLFSDPMHLYDHSGFRAGFETIFVFRISKPYNTDYTPGPGDGLAFFLASADTEIPPQSSGMFLGLFNDASDKIVAVEFDTFSNSEVGDPNYPHIGVDINSIRSSKVCYWNFYDAAITTAKITYNSAHKKLTVHVSTYLHNQPDTLTYDVDLSTKLPDKVKVGISASTGQFSQNTEILSWIFKSN

SEQ ID NO: 206 - protein, 259 aa, Bauhinia ungulata
LTQLNKVKSTNSTLTCFTFPNFWSYSLENGTEITFLGGATYTPGALHLTRIAEDGFPMKRDAGQASYSHPVFLWDSVGHEASFYTSFSFIVRNCDVPKITADGFAFFLAPVDSSVKGFGGCLGLFTYGTAADPSKNQVVAVEFDTWPNTQWSDPSYPHIGIDVNSTVSVATKRSENADAYGNKIGTAHITYDASSKIITVLLTYDNGTHYVLSHVVDLPKILPNWVRIGLSASNGYNETPYILSWSFTSTLDSSKIRAA

SEQ ID NO: 207 - protein, 234 aa, Arachis hypogaea
MGVSFNLHKFDPKHSKEIQFQGDATITDHHIIRLTNLDDEGNPLGNRVGRVLFSDPVHLYDHSGFRAGFETTFVFRISKPYNTDYTPGPGDGLAFFLASADTEIPPQSSGMFLGLFNDASDKIVAVEFDTFSNSEVGDPNYPHIGVDINSIRSSKVCYWHFHDAAITTAKITYNSAHKKLTVHVSTYLHTQPDTLTYDVDLSTKLPDKVKVGISASTGQFSQTTEILSWIFKSN

SEQ ID NO: 208 - protein, 234 aa, Arachis hypogaea
MGVSFNLNKFVPNNSKDIIFQGDATITDHNVIRFTNLDSDGNPLGNRVGRILFSNTMHLYDHSGFRAGFETTFIFRISKPYNSEFAPGPGDGLAFFITNAGTEIPPESSGKFLGLFNDASDKIVAIEFDTFSNFEIGDPNYPHIGVNINSIRSSAIGYWNWHDGAVTTAKITYNSALKRITVSISTYLDNQPDTLTYDIDLSTILPEKVVVGLSASTGQFSQNTEILSWTFKSN

SEQ ID NO: 209 - protein, 283 aa, Sophora flavescens
MAIFQKHLSLPFLVFAIATIVLMSLRGVNSADSLSFTFSDFDPNGEDLLFQGDAHVTSNNILQLTKTSNGVPQQNSIGRALFSAPIHLWENSTNRLSSFESTFTFVLTSPQSNPADGFAFFIAPPDTTIPEGSDGGLLGLFSPENALNPKANQVVAVEFDTFYDKSSNSWDPNYVHIGIDVNQIKSSATVRWDRKEGVIGTARINYNAATGNLSVVSSYPGSQDYVVSYIVDLRTKLPEWVRVGFSASTGQQYQVHSIRSWFFNSVLLYTKAKNEDMYMASVV

SEQ ID NO: 210 - protein, 234 aa, Arachis hypogaea
MRVSFNLHKFASTNSKEIKFLRAATITGHNVIRLTNLESNGNPLGNRVGRVLFSDPVHLYDHSSFRTGFETTFVFHISKPYSSEFAPKPGDGLAFFLANADSEIPLESSRNFLDLFNDASAKVVAVEFDTFSNVEIGDPSGPHIGININSIRSSATSFWNWHDGAVTTAKITYNSALKRITVSVSTYLDNQPNTLSYDVDLSIKLPQKVAVGLSASTGQYSQNTEILSWTFKSN

SEQ ID NO: 211 - protein, 294 aa, Lupinus angustifolius
MAISKKPFLAFLFSTMLVMLVSFCSMVNASDSLSFTYGNFGQDEKDLIFQGDANVISTTNVLQLTKTNGQGVPQQQTFGRALFSAPLRLWQKSTGRVSGFESTIKFVLTSPTTTPSDGFAFFIAPIDTNIPIGTLGGYLGLFNSKTALNASASQVVAVEFDTFYGGDNIWDPNYTHIGINVNTIQSSAYVKWDRVEGAIGTAHIYYNSSTKNLTVVSSYPHGIVYTVSYVVDFKNVLPEWVRVGISGASGGGVQLHTIKQWDFFSSLHYTNPNNNNIIMKKEKEDDIIIAPIVV

SEQ ID NO: 212 - protein, 274 aa, Lupinus albus
MAISNIALVAFFTTIFFMLLSTVNSSDSLSFTFIDFDQNEEDLIFQGDAHVTSNRVLQLTKTNSDGVAQQNSTGRVLYQDKIQLWENSTDRLSTFETIITFNLTSPTPNDPADGFTFFIAPPETTIPHGSEGGLLGLFDLDPSKNQVVAVELDTFYRNPWDPTYDHIGIDVNTVNSSATVKWDRKEGEIGTVCINYNAGTKNLSVVSSYPGSQTYSVSYVVDLRTVLPEWVRVGLSASTGLQTQSHIIKSWFFYSTLDYVTAKKDEDIYIQHVV

SEQ ID NO: 213 - protein, 282 aa, Lupinus albus
MLHTHLKVMAISNIALVAFFTTIFFMLLSTVNSSDSLSFTFIDFDQNEEDLIFQGDAHVTSNRVLQLTKTNSDGVAQQNSTGRVLYQDKIQLWENSTDRLSTFETIITFNLTSPTPNDPADGFTFFIAPPETTIPHGSEGGLLGLFDLDPSKNQVVAVELDTFYRNPWDPTYDHIGIDVNTVNSSATVKWDRKEGEIGTVCINYNAGTKNLSVVSSYPGSQTYSVSYVVDLRTVLPEWVRVGLSASTGLQTQSHIIKSWFFYSTLDYVTAKKDEDIYIQHVV

SEQ ID NO: 214 - protein, 234 aa, Arachis hypogaea
MGVSFNLHKFVPNNSREIIFQGDATITDHNVIRLTNLDSDGNPLGNRVGRVLFSNTVHLYDHSGFRAGFETTFIFRISKPYNSEFAPGPGDGLAFFITNAGTEIPPQSSGKFLGLFNDASDRIVAIEFDTFSNFEIGDPNYPHIGININSIKSSAIGYWNWHDGAVTTAKITYNSALKKITVSVSTYLDSQPDTLTYDIDLSTKLPEKVVVGLSASTGQFSQNTEILSWTFKSN

SEQ ID NO: 215 - protein, 291 aa, Phanera variegata
MLLYNSKPYVLQLILITLLLTQLNKVKSTSSTLTSFTFPDFWSNSQENGTKIIFLGGATYTPGALRLTRIAKDGFPMKSNAGQASYSHPVFLWDSTGHVASFYTSFSFIVRNCDVPKITADGFAFFLAPVDSSVKGFGGCLGLFTYGTAADPSKNQVVAVEFDTWPNTQWSDLSYRHIGIDVNSIVSVATRRWENDDAYGNKIGTAHITYDATSKIITVLLTYDNGRHYQLSHVVDLPKILPKWVRIGFSAATGYNETQYILSWSFTSTLDSTKISALTQKLRSSASYSSM

SEQ ID NO: 216 - protein, 250 aa, Arachis hypogaea
MAISNTNLFLFSVPLLTFTIIFLMQLNKANSSDSLSFSFDNFNQEDGRNLIFQGDSTISPTKNTLHITKVNSQATQLQTPLEDFVLKSPVSEPADGLTFFIAPSNTTVPGLSPGALLGIFDAHSHLNPSLNQIVAVEFDTFSNYWDPSYPHIGIDVNTIQSVKTVQWERREGETVNVLVSYTSRSRKLEVIASYSNGQRFEVSHVVDLRDVLPEWVRVGFSAATGAQYQSHEILSWSFTSSLNYVQMEIK

SEQ ID NO: 217 - protein, 275 aa, Arachis hypogaea
MAISNTNLFLFSVPLLTFTIIFLMQLNKANSSDSLSFSFDNFNQEDGRNLIFQGDSTISPTKNTLHITKVNSQGNPAPNSLGRVLQSAELQLWDKATNRLSEFDCQFSFVLKSPVSEPADGLTFFIAPSNTTVPGLSPGALLGIFDAHSHLNPSLNQIVAVEFDTFSNYWDPSYPHIGIDVNTIQSVKTVQWERREGETVNVLVSYTSRSRKLEVIASYSNGQRFEVSHVVDLRDVLPEWVRVGFSAATGAQYQSHEILSWSFTSSLNYVQMEIK

SEQ ID NO: 218 - protein, 273 aa, Lupinus angustifolius
MAISNIPLVPFFTIIFFILFSTVNSSDSLSFTFSDFNKDEKNLILQGDAHVTSNRVLQLTKTNSTGVAQQYSIGRVLFHDKIQLWQKSPKRLSTFETTITFNLTSPTPNDPADGFTFFLAPPKTTIPPGSDGGLLGLFDPNTALDPSKNQVVAVELDTFYFQNSNQWDPLYYHIGINVNTINSSATVKWDRKEGGIGTVHINYNADTKNLSVVSSYLGSETYHVSYVVDLRNVLPEWVRIGLSASTGQQTQVHIIKSWVFNSTLQHVKKEHGV

SEQ ID NO: 219 - protein, 239 aa, Spatholobus parviflorus
AEETSFVFSKFKPLEPNLILQGDALVTVAGVLQLTNVDSNGVPEPSSLGRATYSAPINIWDSATGLVASFATSFRFTIYAPNIATIADGLAFFLAPVASAPDSGGGFLGLFDSAVGDTTYQTVAVEFDTYENTVFTDPPYTHIGFDVNSISSIKTVKWSLANGEAAKVLITYNSAVKLLVASLVYPSSKTSFILADIVDLSSVLPEWVRVGFSAATGASKGYIETHDVFSWSFASKLAG

SEQ ID NO: 220 - protein, 260 aa, Pterocarpus angolensis
MLLNKAYSQDSLSFGFPTFPSDQKNLIFQGDAQTKNNAVQLTKTDSNGNPVASTVGRILFSAQVHLWEKSSSRVANFQSQFSFSLKSPLSNGADGIAFFIAPPDTTIPSGSGGGLLGLFAPGTAQNTSANQVIAVEFDTFYAQDSNTWDPNYPHIGIDVNSIRSVKTVKWDRRDGQSLNVLVTFNPSTRNLDVVATYSDGTRYEVSYEVDVRSVLPEWVGVGFSAASGEQYQTHTLESWSFTSTLLYTAQKKGENLALEM

SEQ ID NO: 221 - protein, 260 aa, Pterocarpus angolensis
MLLNKAYSQDSLSFGFPTFPSDQKNLIFQGDAQTKNNAVQLTKTDSNGNPVASTVGRILFSAQVHLWEKSSSRVANFQSQFSFSLKSPLSNGADGIAFFIAPPDTTIPSGSGGGLLGLFAPGTAQNTSANQVIAVEFDTFYAQDSNTWDPNYPHIGIDVNSIRSVKTVKWDRRDGQSLNVLVTFNPSTRNLDVVATYSDGTRYEVSYEVDVRSVLPEWVRVGFSAASGEQYQTHTLESWSFTSTLLYTAQKKGENLALEM

SEQ ID NO: 222 - protein, 232 aa, Aequorea australis
MSYGALLFREKIPYVVEMEGDVEGMKFSVRGKGHGDANTGKIEASFICTTGELPVPWSSILTTVTYGAQCFAKYPNDIKDYPKSAMPEGYVQERTITFENDGVYKTRAEVTYEKGSVYNRVTLNGSGFKKGGNILGKKLEFNYNPHCIYVLPDVQNNGIKCYINIVHDVIGGGQIIAAHQQLNTPLGGGPVDIPHYHHIQAHTILSKDPKETRDHMNVVEVFRAIDCKTAYA

SEQ ID NO: 223 - protein, 344 aa, Aequorea victoria
MSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGIAQVQLVESGGALVQPGGSLRLSCAASGFPVNRYSMRWYRQAPGKEREWVAGMSSAGDRSSYEDSVKGRFTISRDDARNTVYLQMNSLKPEDTAVYYCNVNVGFEYWGQGTQVTVS

SEQ ID NO: 224 - protein, 219 aa, Branchiostoma lanceolatum
MSLPATHELHIFGSFNGVDFDMVGRGTGNPNDGYEELNLKSTKGALQFSPWILVPQIGYGFHQYLPFPDGMSPFQAAMKDGSGYQVHRTMQFEDGASLTSNYRYTYEGSHIKGEFQVIGTGFPADGPVMTNSLTAADWCVTKMLYPNDKTIISTFDWTYTTGSGKRYQSTVRTNYTFAKPMAANILKNQPMFVFRKTELKHSKTELNFKEWQKAFTDVM

SEQ ID NO: 225 - protein, 219 aa, Branchiostoma floridae
MPLPATHDIHLHGSINGHEFDMVGGGKGDPNAGSLVTTAKSTKGALKFSPYLMIPHLGYGYYQYLPYPDGPSPFQTSMLEGSGYAVYRVFDFEDGGKLTTEFKYSYEGSHIKADMKLMGSGFPDDGPVMTSQIVDQDGCVSKKTYLNNNTIVDSFDWSYNLQNGKRYRARVSSHYIFDKPFSADLMKKQPVFVYRKCHVKASKTEVTLDEREKAFYELA

SEQ ID NO: 226 - protein, 478 aa, Discosoma sp.
MVSKGEEVIKEFMRFKVRMEGSMNGHEFEIEGEGEGRPYEGTQTAKLKVTKGGPLPFAWDILSPQFMYGSKAYVKHPADIPDYKKLSFPEGFKWERVMNFEDGGLVTVTQDSSLQDGTLIYNVKMRGTNFPPDGPVMQKKTMGWEASTERLYPRDGVLKGEIHQALKLKDGGHYLVEFKTIYMAKKPVQLPGYYYVDTKLDITSHNEDYTIVEQYERSEGRHHLFLYGMDELYKGSTGSGSSGPMVSKGEEAIKEFMRFKVSMEGSMNGHEFEIEGEGEGRPYEGTQTAKLKVTKGGPLPFAWDILSPQFMYGSKAYVKHPADIPDYKKLSFPEGFRWERVMNFEDGGLVTVTQDSSIQDGTLIYKVKVRGTNFPPDGPVMQKKTMGWEASTERLYPRDGVLKGEIHQALKLKDGGHYLVEFKTIYMAKKPVQLPGYYYVDTKLDITSHNEDYTVVEQYERSEGRHHLFLYGMDELYK

SEQ ID NO: 227 - protein, 236 aa, Branchiostoma lanceolatum
MVSKGEEDNMASLPATHELHIFGSFNGVDFDMVGRGTGNPNDGYEELNLKSTKGDLQFSPWILVPQIGYGFHQYLPFPDGMSPFQAAMKDGSGYQVHRTMQFEDGASLTSNYRYTYEGSHIKGEFQVKGTGFPADGPVMTNSLTAADWCVTKMLYPNDKTIISTFDWTYTTGNGKRYQSTARTTYTFAKPMAANILKNQPMFVFRKTELKHSKTELNFKEWQKAFTDVMGMDELYK

SEQ ID NO: 228 - protein, 225 aa, Cyphastrea microphthalma
MNVIKPDMRIKLRMEGAVNGHKFVILGDGNGKPYEGTQTIDVTVKEGGPLPFAYDILTSAFQYGNRVFTKYPDDIADYFKQSFPVGYSWERSMTYEDGGICTVSSDIKMEGNSFIYEIRFHGLNFPSDGPVMQKKTVKWEPSTEKMYVRDGVLKGDVNMALLLEGGGHYRCDFKSTYKAKRAVQLPDYHYIDHRIEILSHDKDYNKVKLCENAAARCSMLPSQAK

SEQ ID NO: 229 - protein, 221 aa, Corynactis californica
MSHSKQVITQEMKMVYHMDGCVNGHSFTIEGEGTGKPYEGNQTLKLRVTKGGPLPFAFDILTATFCYGNRCFCEYPEDMPDYYKQSFPEGYSFERTMMFEDGACCTTSVHLSLTKNCFVHNSTFHGVNFPANGPVMQKKTLNWEPSSEKITPFEGNLKGDVTMFLKLEGGQQHRCQFQTTYKAHKAVKMPPNHIIEHRLVRSQDGDAVQLKEHAVAKCFTA

SEQ ID NO: 230 - protein, 220 aa, Eusmilia fastigiata
MALSKQGIQTDMKMTYSMEGCVNGHNFTVKGGGDGNPYEGHQELRLCITMAKGEPVPFAFDILSAAFCYGNRCFTKYPDEIRDYFKQAFPGGLSWERSMAFEDGASAAVTAEISLEGDCFEHECEFVGVNFPANGPVMQKKTQGWETSTEKMTAHGKVVQGNVPMFLKLEGGGRHRCDFRTTYKAKKDVKMPNSHFITHCLVRKGDGNNTELIEDAEARN

SEQ ID NO: 231 - protein, 224 aa, Echinophyllia sp. SC22
MSVIKPDMKIKLRMEGAVNGHPFAIEGVGLGKPFEGKQSMDLKVKEGGPLPFAYDILTTAFHYGNRVFAKYPENIVDYFKQSFPEGYSWERSMSYEDGGICIATNDITLDGDCYIYEIRFDGVNFPANGPVMQKRTVKWEPSTEKLYVRDGVLKGDVNMALSLEGGGHYRCDFKTTYKAKKVVQLPDYHFVDHHIEIKSHDKDYSNVNLHEHAEAHSGLPRQAK

SEQ ID NO: 232 - protein, 231 aa, Acropora eurystoma
MSYSKQGIVQEMKTKYHMEGSVNGHEFTIEGVATGYPYEGKQMSELVIIKPKGKPLPFSFDILSSVFQYGNRCFTKYPADIPDYFKQAFPDGMSYERSFLFEDGAVATASWNIRLEGNCFIHNSIFHGVNFPADGPVMKKQTIGWDKSFEKMTVSKEVLRGDVTMFLMLEGGGYHRCQFHSTYKTEKPVTLPPNHVVEHQIVRTDLGQSAKGFTVKLEALAAAHVNPLKVQ

SEQ ID NO: 233 - protein, 226 aa, Lobophyllia hemprichii
MSAIKPDMKIKLRMEGNVNGHHFVIDGDGTGKPFEGKQSMDLEVKEGGPLPFAFDILTTAFSYGNRVFAKYPDNIQDYFKQSFPKGYSWERSLTFEDGGICNARNDITMEGDTFYNKVRFYGTNFPANGPVMQKKTLKWEPSTEKMYVRDGVLTGDVEMALLLEGNAHYRCDFRTTYKAKEKGVKLPGAHFVDHCIEILSHDKDYNKVKLYEHAVAHSGLPDNARR

SEQ ID NO: 234 - protein, 239 aa, Aequorea victoria
MVSKGEELFTGVVPILVELDGDVNGHKFSVSGEGEGDATYGKLTLKLICTTGKLPVPWPTLVTTLGYGLMCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 235 - protein, 230 aa, Platygyra lamellina
MEIEDVIKRDMKIKLRMEGAVNGHKFVIIGNGDGKPYEGTQTIDLEVIEGAPLPFAFDILTTVFEYGNRVFAKYPNEIVDYFKQSFPEGYSWERSMTYEDGGICIATNNITLSKVIDNCFHYNIRFDGVNFPPKSPVLQKTTMKWEPSTEIMYVRDGVLKGDVNMALLIEGGGHYRCDFKTIYKAKKVVELPDYHFVDHRITIKSHDKDYNKVLLHEHAKARYGLQRKAK

SEQ ID NO: 236 - protein, 229 aa, Echinophyllia echinata
MSVINPDMKIKLYMEGAVNGHKFEIKGEGNGKPFEGKQTMDLAVVDGGPLPFAFDILTTSFNYGNRVFTKYPDTIVDYFKPSFPEGYSWERSMTYEDGGICIATNDITLLKDTDDSNYFYYKIRFDGVNFAANGPVMQKKTAKWEPSTEKMYVRDGVLKGEVNMALLLEGGGHYRCDFKTTYKAKKVVRLPSYHFVDHRIEILSHSKDYNQVRLHEHAEAHSGLPRQAK

SEQ ID NO: 237 - protein, 236 aa, Branchiostoma lanceolatum
MVSKGEEDNMASLPATHELHIFGSINGVDFDMVGQGTGNPNDGYEELNLKSTKGDLQFSPWILVPHIGYGFHQYLPYPDGMSPFQAAMVDGSGYQVHRTMQFEDGASLTVNYRYTYEGSHIKGEAQVKGTGFPADGPVMTNSLTAADWCRSKKTYPNDKTIISTFKWSYTTGNGKRYRSTARTTYTFAKPMAANYLKNQPMYVFRKTELKHSKTELNFKEWQKAFTDVMGMDELYK

SEQ ID NO: 238 - protein, 239 aa, Branchiostoma lanceolatum
MVSKGEELFTGVVPILVELDGDVNGHKFSVRGEGEGDATNGKLTLKFICTTGKLPVPWPTLVTTFGYGVACFSRYPDHMKQHDFFKSAMPEGYVQERTISFKDDGTYKTRAEVKFEGDTLVNRIELKGIDFKEDGNILGHKLEYNFNSHYVYITADKQKNCIKANFKIRHNVEDGSVQLADHYQQNTPIGDGPVLLPDNHYLSHQSKLSKDPNEKRDHMVLLEFVTAAGITHGMDELYK

SEQ ID NO: 239 - protein, 239 aa, Aequorea victoria
MVSKGEELFTGVVPILVELDGDVNGHKFSVRGEGEGDATNGKLTLKFICTTGKLPVPWPTLVTTFGYGVACFSRYPDHMKQHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSHQSALSKDPNEKRDHMVLLEFVTAAGITHGMDELYK

SEQ ID NO: 240 - protein, 225 aa, Cyphastrea microphthalma
MNVIKPDMRIKLRMEGAVNGHKFVILGDGNGKPYEGTQTIDVTVKEGGPLPFAYDILTSAFQYGNRVFTKYPDDIADYFKQSFPVGYSWERSMTYEDGGICTVSSDIKMEGNSFIYEIRFHGLNFPSDGPVMQKKTVKWEPSTEKMYVRDGVLKGDVNMTLLLEGGGHYRCDFKSTYKAKRAVQLPDYHYIDHRIEILSHDKDYNKVKLCENAAARCSMLPSQAK

SEQ ID NO: 241 - protein, 224 aa, Echinophyllia sp. SC22
MSVIKPDMKIKLRMEGAVNGHPFAIEGVGLGKPFEGKQSMDLKVKEGGPLPFAYDILTTAFHYGNRVFAKYPENIVDYFKQSFPEGYSWERSMSYEDGGICIATNDITLDGDCYINEIRFDGVNFPANGPVMQKRTVKWEPSTEKLYVRDGVLKGDVNMALSLEGGGHYRCDFKTTYKAKKVVQLPDYHFVDHHIEIKSHDKDYSNVNLHEHAEAHSGLPRQAK

SEQ ID NO: 242 - protein, 236 aa, Branchiostoma lanceolatum
MVSKGEEDNMASLPATHELHIFGSINGVDFDMVGQGTGNPNDGYEELNLKSTKGDLQFSPWILVPHIGYGFHQYLPYPDGMSPFQAAMVDGSGYQVHRTMQFEDGASLTVNYRYTYEGSHIKGEAQVKGTGFPADGPVMTNSLTAADWSRSKKTYPNDKTIISTFKWSYTTGNGKRYRSTARTTYTFAKPMAANYLKNQPMYVFRKTELKHSKTELNFKEWQKAFTDVMGMDELYK

SEQ ID NO: 243 - protein, 464 aa, Discosoma sp.
MVASSEDVIKEFMRFKVRMEGSVNGHEFEIEGEGEGRPYEGTQTAKLKVTKGGPLPFAWDILSPQFQYGSKAYVKHPADIPDYKKLSFPEGFKWERVMNFEDGGVVTVTQDSSLQDGTLIYKVKFRGTNFPPDGPVMQKKTMGWEASTERLYPRDGVLKGEIHQALKLKDGGHYLVEFKTIYMAKKPVQLPGYYYVDTKLDITSHNEDYTIVEQYERSEGRHHLFLGHGTGSTGSGSSGTASSEDVIKEFMRFKVRMEGSVNGHEFEIEGEGEGRPYEGTQTAKLKVTKGGPLPFAWDILSPQFQYGSKAYVKHPADIPDYKKLSFPEGFKWERVMNFEDGGVVTVTQDSSLQDGTLIYKVKFRGTNFPPDGPVMQKKTMGWEASTERLYPRDGVLKGEIHQALKLKDGGHYLVEFKTIYMAKKPVQLPGYYYVDTKLDITSHNEDYTIVEQYERSEGRHHLFL

SEQ ID NO: 244 - protein, 226 aa, Lobophyllia hemprichii
MSAIKPDMKIKLRMEGNVNGHHFVIDGDGTGKPFEGKQSMDLEVKEGGPLPFAFDILTTAFLYGNRVFAKYPDNIQDYFKQSFPKGYSWERSLTFEDGGICNARNDITMEGDTFYNKVRFYGTNFPANGPVMQKKTLKWEPSTEKMYVRDGVLTGDVEMALLLEGNAHYRCDFRTTYKAKEKGVKLPGAHFVDHCIEILSHDKDYNKVKLYEHAVAHSGLPDNARR

SEQ ID NO: 245 - protein, 224 aa, Echinophyllia sp. SC22
MSVIKPDMKIKLRMEGAVNGHPFAIEGVGLGKPFEGKQSMDLKVKEGGPLPFAYDILTTAFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDVNMALSLEGGGHYRCDFKTTYKAKKVVQLPDYHFVDHHIEIKSHDKDYSNVNLHEHAEAHSELPRQAK

SEQ ID NO: 246 - protein, 224 aa, Echinophyllia echinata
MNVIKPDMKIKLRMEGAVNGHKFAIEGEGNGQPFEGKQTMNLKVKEGGPLPFAYDILTTIFNYGNRVFVKYPDDIVDYFKQSFPEGYSWERSMIYEDGGICIATNDITLEGDCFVYKIRFDGVNFPAKSPVLQKMTKKWEPSTEKLYVRDGVLKGDVNMALLLEGGGHFRCDFKTTYKAKKVVQLPDYHFVDHRIEIMSHDKDYNNVKLCEHAEAHSGLPGQAK

SEQ ID NO: 247 - protein, 225 aa, Galaxea fascicularis
MNVIKPDMKIKLCMRGTINGHNFVIEGEGKGNPYEGTQILDLNVTEGAPLPFAYDILTTVFQYGNRAFTKYPADIQDYFKQTFPEGYHWERSMTYEDQGICTATSNISMRGDCFFYDIRFDGVNFPPNGPVMQKKTLKWEPSTEKMYVRDGVLKGDVNMALLLEGGGHYRCDFKTTYKAKKDVRLPDYHFVDHRIEILKHDKDYNKVELYENAVARYSMLPSQAK

SEQ ID NO: 248 - protein, 239 aa, Olindias formosus
MVSKGEEASGRALFQYPMTSKIELNGEINGKKFKVAGEGFTPSSGRFNMHAYCTTGDLPMSWVVIASPLQYGFHMFAHYPEDITHFFQECFPGSYTLDRTLRMEGDGTLTTHHEYSLEDGCVTSKTTLNASGFDPKGATMTKSFVKQLPNEVKITPHGPNGIRLTSTVLYLKEDGTIQIGTQDCIVTPVGGRKVTQPKAHFLHTQIIQKKDPNDTRDHIVQTELAVAGNLWHGMDELYK

SEQ ID NO: 249 - protein, 225 aa, Sarcophyton sp.
MSVIKQEMKIKLHMDGNVNGHAFVIEGDGKGKPYDGTQTLNLSVKEGAPLPFSYDILTNAFQYGNRAFTKYPADIPDYFKQTFPEGYSWERTMSYEDNAICNVRSEISMEGDCFIYKIRFDGKNFPPNGPVMQKKTLKWEPSTEMMYARDGFLMGDVNMALLLEGGGHHRCDFKTSYKAAKKNVQLPDYHYVDHRIEILSHDRDYNKVKLYENAVARYSLLPSQA

SEQ ID NO: 250 - protein, 353 aa, Aequorea victoria
MSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYKAQVQLVESGGALVQPGGSLRLSCAASGFPVNRYSMRWYRQAPGKEREWVAGMSSAGDRSSYEDSVKGRFTISRDDARNTVYLQMNSLKPEDTAVYYCNVNVGFEYWGQGTQVTVS

SEQ ID NO: 251 - protein, 226 aa, Lobophyllia hemprichii
MSAIKPDMKIKLRMEGNVNGHHFVIDGDGTGKPFEGKQSMDLEVKEGGPLPFAFDILTTAFHYGNRVFAKYPDNIQDYFKQSFPKGYSWERSLTFEDGGICNARNDITMEGDTFYNKVRFYGTNFPANGPVMQKKTLKWEPSTEKMYVRDGVLTGDVEMALLLEGNAHYRCDFRTTYKAKEKGVKLPGAHFVDHCIEILSHDKDYNKVKLYEHAVAHSGLPDNARR

SEQ ID NO: 252 - protein, 222 aa, Pontella meadi
MPDMKLECHISGTMNGEEFELIGAGDGNTDEGRMTNKMKSIKGPISFSPYLLSHILGYGYYHFATFPAGYENIYLHAMKNGGYSNVRTERYEDGGIISITFNYRYEGNKIIGDFKVVGTGFPTNSLIFTDKIIKSNPTCENMFPKADNTLVNAYTRTYLLKDGGYYSAQVNNHMHFKSAIHTTMLQNGGSMFTYRVVEETHTQNEVAIVEYQNVFKTPTAFA

SEQ ID NO: 253 - protein, 225 aa, Cyphastrea microphthalma
MNVIKPDMRIKLRMEGAVNGHKFVILGDGNGKPYEGTQTIDVTVKEGGPLPFAYDILTSAFQYGNRVFTKYPDDIADYFKQSFPVGYSWERSMTYEDGGICTVSSDIKMEGNSFIYEIRFHGLNFPSDGPVMQKKTVKWEPSTEKMYVRDGVLKGDVNMRLLLEGGGHYRCDFKSTYKAKRAVQLPDYHYIDHRIEILSHDKDYNKVKLCENAAARCSMLPSQAK

SEQ ID NO: 254 - protein, 222 aa, Pontella mimocerami
MPNMKLECRISGTMNGEEFELVGNGDGNTDEGRMTNKMKSTKGPLSFSPYLLSHVLGYGYYHYATFPAGYENVYLHAMKNGGYSNTRTERYEDGGIISATFNYRYEGDKIIGDFKVVGTGFPTNSIIFTDKIIKSNPTCEHIYPKADNILVNAYTRTWMLRDGGYYSAQVNNHMHFKSAIHPTMLQNGGSMFTYRKVEELHTQTEVGIVEYQHVFKTPTAFA

SEQ ID NO: 255 - protein, 222 aa, Pontella mimocerami
MPNMKLECRISGTMNGEEFKLVGAGEGNTDEGRMTNKVKSTKGPLPFSPYLLSHVLGYGYYHYATFPAGYENVYLHAMKNGGYSNTRTERYEDGGIISATFNYRYEGDKIIGDFKVVGTGFPTNSIIFTDKIIKSNPTCEHIYPKADNILVNAYTRTWMLRDGGYYSAQVNNHMHFKSAIHPTMLQNGGSMFTYRKVEELHTQTEVGIVEYQHVFKRPTAFA

SEQ ID NO: 256 - protein, 227 aa, Lobophyllia hemprichii
MVSAIKPDMRIKLRMEGNVNGHHFVIDGDGTGKPYEGKQTMDLEVKEGGPLPFAFDILTTAFHYGNRVFVKYPDNIQDYFKQSFPKGYSWERSLTFEDGGICYARNDITMEGDTFYNKVRFYGTNFPANGPVMQKKTLKWEPSTEKMYVRDGVLTGDIHMALLLEGNAHYRCDFRTTYKAKEKGVKLPGYHFVDHAIEILSHDKDYNKVKLYEHAVAHSGLPDNARR

SEQ ID NO: 257 - protein, 222 aa, Pontellidae sp. SL-2003
MAAMKIECRITGTMNGVEFELVGGGEGNTDQGRMTNKMKSTKGPLSFSPYLLSHVMGYGFYHFGTFPSGYENPYVHAMTNGGYTNTRIESYEDGGVLYLTFNYRLDGNKIIGDFKCVGTGFPEDSVIFTDKIIKSNPNCEHFYPMAENIMKNAYMRTLSLRDGGYYSGQVTSHIHFKNAIHPSILHNGGSMFTYRRVEELHTQTDLGIVEYQHVFKTPTAFA

SEQ ID NO: 258 - protein, 222 aa, Pontella meadi
MPDMKLECHISGTMNGEEFELIGSGDGNTDQGRMTNNMKSIKGPLSFSPYLLSHILGYGYYHFATFPAGYENIYLHAMKNGGYSNVRTERYEDGGIISITFNYRYEGSKIIGDFKVIGTGFPTDSLIFTDKIIKSNPTCENMFPKADNILVNAYTRTYLLKDGGYYSAQVNNHMHFKSAIHPTMLQNGGSMFTHRVVEENHTKTNVAIVEYQNVFKTPTAFA

SEQ ID NO: 259 - protein, 232 aa, Artificial Sequence
  Synthetic Construct
MVSKGEAVIKEFMRFKVHMEGSMNGHEFEIEGEGEGRPYEGTQTAKLKVTKGGPLPFSWDILSPQFMYGSRAFTKHPADIPDYYKQSFPEGFKWERVMNFEDGGAVTVTQDTSLEDGTLIYKVKLRGTNFPPDGPVMQKKTMGWEASTERLYPEDGVLKGDIKMALRLKDGGRYLADFKTTYKAKKPVQMPGAYNVDRKLDITSHNEDYTVVEQYERSEGRHSTGGMDELYK

SEQ ID NO: 260 - protein, 239 aa, Aequorea victoria
MVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSKLSKDPNEKRDHMVLLEFVTAAGITLGMDELYK

SEQ ID NO: 261 - protein, 221 aa, Corynactis californica
MSLSKQVVKQDMNMTYHMDGCVNGHSFTIEGEGRGNPFKGQQTLKLRVTKGGPLPFAFDILSATFTYGNRCFCDYPEDMPDYFKQSLPEGYSWERTMMYEDGGCGTASAHISLNKTGFVHKSTFHGVNFPANGPVMQRKTVNWEPSTEKITACDGTLKGDVTMFLLLGGGYQQKCQFQTTYRTDKTVKMPPNHIIEHRLVRSEDGDAVQIQEHAVAKYFTV

SEQ ID NO: 262 - protein, 234 aa, Phialidium sp. SL-2003; identical to SEQ ID NO: 67

SEQ ID NO: 263 - protein, 239 aa, Aequorea victoria
MVSKGEELFTGVVPILVELDGDVNGHKFSVTGEGEGDATYGKLTLKFICTTGKLPVPWPTLVTTFGYGLTCFARYPDHMKQHDFFKSAMPEGYVQERTIFFKDDGNYKTRAEVKFEGDTLVNRIELKGIDFKEDGNILGHKLEYNHNSHYVYIMADKQKNGIKANFKIRHNIEDGSVQLADHYQQNTPIGDGPVLLPDNHYLSYQSQLSKDPNEERDHTVLLEFVTAAGITLGMGELYK

SEQ ID NO: 264 - protein, 225 aa, Cyphastrea microphthalma
MNVIKPDMRIKLRMEGAVNGHKFVILGDGNGKPYEGTQTIDVTVKEGGPLPFAYDILTSAFQYGNRVFTKYPDDIADYFKQSFPVGYSWERSMTYEDGGICTVSSDIKMEGNSFIYEIRFHGLNFPSDGPVMQKKTVKWEPSTEKMYVRDGVLKGDVKMTLLLEGGGHYRCDFKSTYKAKRAVQLPDYHYIDHRIEILSHDKDYNKVKLCENAAARCSMLPSQAK

SEQ ID NO: 265 - protein, 232 aa, Olindias formosus
MASGRALFQYPMTSKIELNGEINGKKFKVAGEGFTPSSGRFNMHAYCTTGDLPMSWVVIASPLQYGFHMFAHYPEDITHFFQECFPGSYTLDRTLRMEGDGTLTTHHEYSLEDGCVTSKTTLNASGFDPKGATMTKSFVEQLPNQVKITAEGNGIRLTSTVLYLKKDGTIQIGTQDCIVKPVGGRKVTQPKAHFLHTQIIQKKDPNDTRDHIVQTELAVAGNLWHEPSASAV

SEQ ID NO: 266 - protein, 239 aa, Aequorea victoria
MVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSFQSALSKDPNEKRDHMVLLEFVTAAGITLGMDELYK

SEQ ID NO: 267 - protein, 231 aa, Acropora aculeus
MSYSKQGIVQEMKTKYRMEGSVNGHEFTIEGVGTGYPYEGKQMSELVIIKPKGKPLPFSFDILSSVFQYGNRCFTKYPADMPDYFKQAFPDGMSYERSFLFEDGAVATASWNIRLEGNCFIHNSIFHGVNFPADGPVMKKKTIGWDKSFEKMTVSKEVLRGDVTMFLMLEGGGYHRCQFHSTYKTEKPVELPPNHVVEHQIVRTDLGQSAKGFTVKLEAHAAAHVNPLKVQ

SEQ ID NO: 268 - protein, 239 aa, Aequorea victoria
MVSKGEELFTGVVPILVELDGDVNGHKFSVSGEGEGDATYGKLTLKLICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 269 - protein, 227 aa, Lobophyllia hemprichii
MVSAIKPDMRIKLRMEGNVNGHHFVIDGDGTGKPYEGKQTMDLEVKEGGPLPFAFDILTTAFHYGNRVFVKYPDNIQDYFKQSFPKGYSWERSLTFEDGGICNARNDITMEGDTFYNKVRFYGTNFPANGPVMQKKTLKWEPSTEKMYVRDGVLTGDIEMALLLEGNAHYRCDFRTTYKAKEKGVKLPGAHFVDHAIEILSHDKDYNKVKLYEHAVAHSGLPDNARR

SEQ ID NO: 270 - protein, 218 aa, Verrillofungia concinna
MVSVIKPEMKMRYYMDGSVNGHEFTIEGEGTGRPYEGHQEMTLRVTMAEGGPMPFAFDLVSHVFCYGHRVFTKYPEEIPDYFKQAFPEGLSWERSLEFEDGGSASVSAHISLRGNTFYHKSKFTGVNFPADGPIMQNQSVDWEPSTEKITASDGVLKGDVTMYLKLEGGGNHKCQFKTTYKAAKEILEMPGDHYIGHRLVRKTEGNITEQVEDAVAHS

SEQ ID NO: 271 - protein, 224 aa, Favites abdita
MSVIKPDMKIKLRMEGAVNGHKFAIEGEGKGQPFQGKQTMNLKVKEGGPLPFAYDILTTIFNYGNRVFAKYPDDIVDYFKQSFPEGYSWERSMTYEDGGICIATNDITLDGDCFVYKIRFDGVNFPAKSPVLQKKTQKWEPSTEKLYVRDGLLKGDVNMALLLEGGGHYRCDFKTTYKAKKVVQLPDYHFVDHCIEIVSHDKDYNNVKLCEHAEAHSGLPKEAK

SEQ ID NO: 272 - protein, 226 aa, Lobophyllia hemprichii
MSAIKPDMKIKLRMEGNVNGHHFVIDGDGTGKPFEGKQSMDLEVKEGGPLPFAFDILTTAFCYGNRVFAKYPDNIQDYFKQSFPKGYSWERSLTFEDGGICIARNDITMEGDTFYNKVRFYGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 273 - protein, 224 aa, Echinophyllia sp. SC22
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDLNMALSLEGGGHYRCDFKTTYKAKKVVQLPDYHFVDHHIEIKSHDKDYSNVNLHEHAEAHSELPRQAK

SEQ ID NO: 274 - protein, 226 aa, Agaricia fragilis
MSVIVKEMMTKLHMEGTVNGHAFTIEGKGKGDPYNGVQSMNLDVKGGAPLPFSFDLLTPAFMYGNRVFTKYPEDIPDFFKQVFPEGYHWERSITFEDQAVCTATSHIRLDQKEMCFIYDVRFHGVNFPANGPIMQKKILGWEPSTEKMYARDGVLKGDVNMTLRVEGGGHYRADFRTTYKAKKPVNLPGYHFIDHRIEITKHSKDYTNVALYEAAVARHSPLPKVA

SEQ ID NO: 275 - protein, 224 aa, Stylocoeniella sp. NOA-2005
MALTKQCIANEMTMTFHMDGCVNGHYFTIEGEGSGRPYEGKQMSKFKVTKGGPLPFSFDILSSAFKYGNRCFTAYPAGMHDYFKQAFPEGMSYERTFTFEDGGVATASGDISLKGNCFVHKSMFHGVNFPADGPVMKKKTTGWDPSFEKMTVCNGILKGDVTMFLMLEDGKNYKCQFHTSYKTKKPVTLPSNHVVEHRIVRTNLDKAGNHVQLDEHAVAHVNPL

SEQ ID NO: 276 - protein, 234 aa, Phialidium sp. SL-2003
GSSGALLFHGKIPYVVEMEGNVDGHTFSIRGKGYGDASVGKVDAQFICTTGDVPVPWSTLVTTLTYGAQCFAKYGPELKDFYKSCMPDGYVQERTITFEGDGNFKTRAEVTFENGSVYNRVKLNGQGFKKDGHVLGKNLEFNFTPHCLYIWGDQANHGLKSAFKICHEITGSKGDFIVADHTQMNTPIGGGPVHVPEYHHMSYHVKLSKDVTDHRDNMSLKETVRAVDCRKTYD

SEQ ID NO: 277 - protein, 238 aa, Aequorea victoria
MSKGEELFTGVVPILVELDGDVNGHKFSVSGEGEGDATYGKLTLKFICTTGKLPVPWPTLVTTLTYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 278 - protein, 239 aa, Aequorea victoria
MVSKGEELFTGVVPILVELDGDVNGHKFSVSGEGEGDATYGKLTLKFICTTGKLPVPWPTLVTTFGYGLMCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 279 - protein, 225 aa, Dendronephthya sp.
MNLIKEDMRVKVHMEGNVNGHAFVIEGEGKGKPYEGTQTLNLTVKEGAPLPFSYDILTTALHYGNRVFTKYPEDIPDYFKQSFPEGYSWERTMTYEDKGICTIRSDISLEGDCFFQNVRFNGMNFPPNGPVMQKKTLKWEPSTEKLHVRDGLLVGNINMALLLEGGGHYLCDFKTTYKAKKVVQLPDYHFVDHRIEILSNDSDYNKVKLYEHGVARYSPLPSQAW

SEQ ID NO: 280 - protein, 236 aa, Discosoma sp.
MVSKGEENNMAIIKEFMRFKVRMEGTVNGHEFEIEGEGEGRPYEGFQTAKLKVTKGGPLPFAWDILSPLFTYGSKAYVKHPADIPDYFKLSFPEGFKWERVMNYEDGGVVTVTQDSSLQDGEFIYKVKMRGTNFPSDGPVMQKKTMGWEASSERMYPEDGALKGEIRMRLKLKDGGHYTSEVKTTYKAKKSVQLPGAYIVGIKLDITSHNEDYTIVEQYERAEGRHSTGGMDELYK

SEQ ID NO: 281 - protein, 231 aa, Acropora nobilis
MSYSKQGIAQEMKTKYHMEGSVNGHEFTIEGVGTGYPYEGKQMSELVIIKPAGKPLPFSFDILSSVFQYGNRCFTKYPADMPDYFKQAFPDGMSYERSFLFEDGAVATASWKIRLEGNCFIHNSIFNGVNFPADGPVMEKKTIGWDKSFEKMTVSKEVLRGDVTMFLMLEGGGSHRCQFHSTYKTEKPVTLPPNHVVEHQIVRTDLGQSAKGFTVKLEAHAAAHVNPLKVK

SEQ ID NO: 282 - protein, 231 aa, Entacmaea quadricolor
MNSLIKENMRMMVVMEGSVNGYQFKCTGEGDGNPYMGTQTMRIKVVEGGPLPFAFDVLATSFMYGSKTFIKHTKGIPDFFKQSFPEGFTWERVTRYEDGGVITVMQDTSLEDGCLVYHAKVTGVNFPSNGAVMQKKTKGWEPNTEMLYPADGGLRGYSQMALNVDGGGYLSCSFETTYRSKKTVENFKMPGFHFVDHRLERLEESDKEMFVVQHEHAVAKFCDLPSKLGRL

SEQ ID NO: 283 - protein, 239 aa, Aequorea victoria
MVSKGEELFTGVVPILVELDGDVNGHKFSVSGEGEGDATYGKLTLKFICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSALSKDPNEKRDHMVLLEFVTAAGITLGMDELYK

SEQ ID NO: 284 - protein, 232 aa, Artificial Sequence
  Synthetic Construct
MVSKGEAVIKEFMRFKVHMEGSMNGHEFEIEGEGEGRPYEGTQTAKLKVTKGGPLPFSWDILSPQFMYGSRAFIKHPADIPDYYKQSFPEGFKWERVMNFEDGGAVTVTQDTSLEDGTLIYKVKLRGTNFPPDGPVMQKKTMGWEASTERLYPEDGVLKGDIKMALRLKDGGRYLADFKTTYKAKKPVQMPGAYNVDRKLDITSHNEDYTVVEQYERSEGRHSTGGMDELYK

SEQ ID NO: 285 - protein, 234 aa, Montipora efflorescens
MALSKNGLTKNMTTKYRMEGCVDGHKFVITGDGIGDPFEGKQTSIDLCVVEGGPLPFSEDILSAVFDYGNRVFTKYPQDLVDYFKNSCPAGYTWQRSFLFEDGAVCTASADITVSVEENCFYHESKFHGVNFPADGPVMKKMTTNWEPSCEKITPIPNEGILKGDVTMFLLLKDGGRYRCQFDTVYKAKSDPKTIMMPDWHFIQHKLNREDRSDAKHQKWRLVENAIAYRSTLS

SEQ ID NO: 286 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFAEYPDHIQDYFKQSFPKGYSWERSLTFEDGGICIARNDITMEGDTFYNKVRFHGVNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 287 - protein, 231 aa, Entacmaea quadricolor
MSELIKENMHMKLYMEGTVNNHHFKCTSEGERKPYEGTQTMKIKVVEGGPLPFAFDILATSFMYGSKTFINHTQGIPDLFKQSFPEGFTWERITTYEDGGVLTATQDTSLQNGCIIYNVKINGVNFPSNGSVMQKKTLGWEANTEMLYPADGGLRGHSQMALKLVGGGYLHCSFKTTYRSKKPAKNLKMPGFHFVDHRLERIKEADKETYVEQHEMAVAKYCDLPSKLGHR

SEQ ID NO: 288 - protein, 221 aa, Corynactis californica
MSLSKQVLPRDVKMRYHMDGCVNGHQFIIEGEGTGKPYEGKKILELRVTKGGPLPFAFDILSSVFTYGNRCFCEYPEDMPDYFKQSLPEGHSWERTLMFEDGGCGTASAHISLDKNCFVHKSTFHGVNFPANGPVMQKKTLNWEPSSELITAGDGILKGDVTMFLMLEGGHRLKCQFTTSYKAKKAVKMPPNHIIEHRLVRKEVADAVQIQEHAVAKHFIV

SEQ ID NO: 289 - protein, 228 aa, Echinophyllia echinata
MNVIKPDMKIRLRMEGAVNGHKFVIIGKGDGKPYEGTQTMDLEVIEGGPLPFAFDILTTVFKYGNRAFVKYPTDIADYFKQSFPEGFSWERSMTYEDGGICIATNDITLSKDIANCFDYNIRFDGVNFPPNSPVLQKTTIKWEPSTENMYVRDGVLKGDINMSLLLEGGAGHYRCDFKTTYKAKKAVKLPDYHFVDHRITIVSHDKDYNKVKLREHAEAHSGLQMEAK

SEQ ID NO: 290 - protein, 235 aa, Clytia gregaria
MTTLTEGAKLFEKEIPYITELEGDVEGMKFIIKGVGTGDATTGTIKAKYICTTGDLPVPWATILSSLSYGVFCFAKYPRHIADFFKSTQPDGYSQDRIISFDNDGQYDVKAKVTYENGTLYNRVTVKGTGFKSNGNILGMRVLYHSPPHAVYILPDRKNGGMKIEYNKAFDVMGGGHQMARHAQFNKPLGAWEEDYPLYHHLTVWTSFGKDPDDDETDHLNIVEVIKAVDLETYR

SEQ ID NO: 291 - protein, 238 aa, Aequorea victoria; identical to SEQ ID NO: 44

SEQ ID NO: 292 - protein, 219 aa, Chiridius poppei
MTTFKIESRIHGNLNGEKFELVGGGVGEEGRLEIEMKTKDKPLAFSPFLLSHCMGYGFYHFASFPKGTKNIYLHAATNGGYTNTRKEIYEDGGILEVNFRYTYEFNKIIGDVECIGHGFPSQSPIFKDTIVKSCPTVDLMLPMSGNIIASSYARAFQLKDGSFYTAEVKNNIDFKNPIHESFSKSGPMFTHRRVEETHTKENLAMVEYQQVFNSAPRDM

SEQ ID NO: 293 - protein, 233 aa, Montipora efflorescens
MALSKNGVKDRMKLKFHMEGSVNGHEFTIKGEGTGQPYEGTQSIQLRVEKGGPLPFSVDILSAVFLYGNRVFTKYPQDLVDYFKNSCPAGYTWQRSFLFEDGAVCTASADITVSVEENCFYHESKFHGVNFPADGPVMKKMTTNWEPSCEKITPIPNEGILKGDVTMFLLLKDGGRYRCQFDTVYKAKSDPKTIMMPDWHFIQHKLNREDRSDAKHQKWRLVENAIAYRSTLS

SEQ ID NO: 294 - protein, 226 aa, Lobophyllia hemprichii
MSAIKPDMKIKLRMEGNVNGHHFVIDGDGTGKPFEGKQSMDLEVKEGGPLPFAFDILTTAFHYGNRVFAKYPDNIQDYFKQSFPKGYSWERSLTFEDGGICNARNDITMEGDTFYNKVRFYGTNFPANGPVMQKKTLKWEPSTEKMYVRDGVLTGDIEMALLLEGNAHYRCDFRTTYKAKEKGVKLPGAHFVDHCIEILSHDKDYNKVKLYEHAVAHSGLPDNARR

SEQ ID NO: 295 - protein, 220 aa, Porites porites
MALSKQVTMKYHMDGRFEDKEFTIEGEGTGKPYEGKQTVTLWVTKGAPLPFSFDILSAVFLYGNRAFTDYPKGIVDYFKPSFPEGYSFERTLEFEDGGYCTASADISLDSASNCFIHKSSFKGVKFPDNGPVKQKKTTNWEPSIEKMTVRDGILKGDVTMFLSLTDGGNHRCQFSTLYKAKKAVKLPTESHYVEHRLVRTDLPNGKVQLEEHAAARLNTV

SEQ ID NO: 296 - protein, 238 aa, Aequorea victoria
MSKGEELFTGVVPILVELDGDVNGHKFSVRGEGEGDATNGKLTLKFICTTGKLPVPWPTLVTTLTYGVLCFSRYPDHMKRHDFFKSAMPEGYVQERTISFKDDGTYKTRAEVKFEGDTLVNRIELKGIDFKEDGNILGHKLEYNFNSHNVYITADKQKNGIKAYFKIRHNVEDGSVQLADHYQQNTPIGDGPVLLPDNHYLSTQSVLSKDPNEKRDHMVLLEDVTAAGITHGMDELYK

SEQ ID NO: 297 - protein, 226 aa, Lobophyllia hemprichii
MSAIKPDMKIKLRMEGNVNGHHFVIDGDGTGKPFEGKQSMDLEVKEGGPLPFAFDILTTAFEYGNRVFAKYPDNIQDYFKQSFPKGYSWERSLTFEDGGICIARNDITMEGDTFYNKVRFYGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 298 - protein, 232 aa, Olindias formosus
MASGRALFQYPMTSKIELNGEINGKKFKVAGEGFTPNSGRFNMHAYCTTGDLPMSWVVIASPLQYGFHMFAHYPEDITHFFQECFPGSYTLDRTLRMEGDGTLTTHHEYSLKDGCVTSKTTLNASGFDPKGATMTKSFVEQLPNQVEITAEGNGIRLTSTVLYLKKDGTIQIGRQDCIVKPVGGKKVTQPKAHFLHTQIIQKKDPNDTRDHIVQTELAVAGNPWHEPSASAV

SEQ ID NO: 299 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFVEYPDHIQDYFKQSFPKGYSWERSLTFEDGGICIARNDITMEGDTFYNKVRFHGTNFPANGPVMQKKTLKWEPSTEKMYVRDGVLTGDIHAALLLEGNAHYRCDFRTTYKAKEKGVKLPGYHLVDHCIEILSHDKDYNKVKLYEHAVAHSGLPDNARR

SEQ ID NO: 300 - protein, 231 aa, Porites porites
MALSKQSGVKDVMNTELHMDGIVNGHPFEIKGKGKGNPYKGVQTMKLTVIKGAPLPFSIDILLPQHMYGSKPFIKYPESIPDYIKLSFPEGITWERSMTFEDGAVCTVSNDSRLDGDSFIYEVRFLGVNFPRDGPVMQKKTRGWDPSTERLYECGGWQRGDVHMALKLENGGHYTCDFKTTYKSKKGLKVPPYHFVDHKLDLLSHNTDGATFEEFEQREIAHAHLSNLPVA

SEQ ID NO: 301 - protein, 239 aa, Aequorea victoria
MVSKGEELFTGVVPILVELDGDVNGHKFSVRGEGEGDATNGKLTLKFISTTGKLPVPWPTLVTTLTYGVQSFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSKLSKDPNEKRDHMVLLEFVTAAGITHGMDELYK

SEQ ID NO: 302 - protein, 239 aa, Aequorea victoria
MVSKGEELFTGVVPILVELDGDVNGHKFSVRGEGEGDATNGKLTLKFISTTGKLPVPWPTLVTTLTYGVQSFSRYPDHMKRHDFFKSAMPEGYVQERTISFKDDGTYKTRAEVKFEGDTLVNRIELKGIDFKEDGNILGHKLEYNFNSHNVYITADKQKNGIKANFKIRHNVEDGSVQLADHYQQNTPIGDGPVLLPDNHYLSTQSVLSKDPNEKRDHMVLLEFVTAAGITHGMDELYK

SEQ ID NO: 303 - protein, 231 aa, Acropora millepora
MSYSKQGIVQEMKTKYHMEGSVNGHEFTIEGVGTGYPYEGKQMSELVIIKPAGKPLPFSFDILSSVFQYGNRCFTKYPADMPDYFKQAFPDGMSYERSFLFEDGAVATASWNIRLEGNCFIHKSIFHGVNFPADGPVMKKKTIDWDKSFEKMTVSKEVLRGDVTMFLMLEGGGSHRCQFHSTYKTEKPVTLPPNHVVEHQIVRTDLGQSAKGFTVKLEAHAAAHVNPLKVK

SEQ ID NO: 304 - protein, 217 aa, Verrillofungia concinna; identical to SEQ ID NO: 68

SEQ ID NO: 305 - protein, 226 aa, Lobophyllia hemprichii
MSAIKPDMKIKLRMEGNVNGHHFVIDGDGTGKPFEGKQSMDLEVKEGGPLPFAFDILTTAFSYGNRVFAKYPDNIQDYFKQSFPKGYSWERSLTFEDGGICIARNDITMEGDTFYNKVRFYGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 306 - protein, 239 aa, Aequorea victoria
MVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSKLSKDPNEKRDHMVLLEFVTAAGITLGMDELYK

SEQ ID NO: 307 - protein, 262 aa, Anthoathecata
MNVMRYNRGFCRVLQNGVKNLRSRNCSTEEKPVILGAMTETFQKKLPYKLELDGDVDGQTFKVIGEGVGDATTGVIEGKYVCTEGEVPISWVSLITSLSYGAKCFVRYPNEINDFFKSTFPSGYHQERKITYENDGVLETAAKITMESGAIVNRINVKGTGFDKDGHVCQKNLESSPPSTTYVVPEGEGIRIIYRNIYPTKDGHYVVADTQQVNRPIRAQGTSAIPTYHHIKSKVDLSTDPEENKDHIIIKETNCAFDADFS

SEQ ID NO: 308 - protein, 232 aa, Montipora efflorescens
MALSKQSLPSDMKLIYHMDGNVNGHSFVIKGEGEGKPYEGTHTIKLQVVEGSPLPFSADILSTVFQYGNRCFTKYPPNIVDYFKNSCSGGGYKFGRSFLYEDGAVCTASGDITLSADKKSFEHKSKFLGVNFPADGPVMKKETTNWEPSCEKMTPNGMTLIGDVTGFLLKEDGKRYKCQFHTFHDAKDKSKKMPMPDFHFVQHKIERKDLPGSMQTWRLTEHAAACKTCFTE

SEQ ID NO: 309 - protein, 225 aa, Galaxea fascicularis; identical to SEQ ID NO: 57

SEQ ID NO: 310 - protein, 234 aa, Obelia sp.
MSSAGALLFTNKIPYVTELEGDVNGMKFTIHGKGTGDASTGHIEAKYVCTSGEIPVPWATLVSTMCYGVQCFAKYPSHIKDFYKSAMPEGYIQERTISFEGDGVYKTRAMVTYERGSIYNRVTLTGENFKKDGHILRKNVAFQCLPSILYILPDTVNNGIRVEFNQVYDIEGEIEKLVTKCSQMNRPLAESAAVHIPRYHHISKHTKLSKDLDERRDHMCLVEVVKAVDLDTYQ

SEQ ID NO: 311 - protein, 226 aa, Discosoma sp.
MVASSEDVIKEFMRFKVRMEGSVNGHEFEIEGEGEGRPYEGTQTAKLKVTKGGPLPFAWDILSPQFQYGSKAYVKHPADIPDYKKLSFPEGFKWERVMNFEDGGVVTVTQDSSLQDGTLIYKVKFRGTNFPPDGPVMQKKTMGWEASTERLYPRDGVLKGEIHQALKLKDGGHYLVEFKTIYMAKKPVQLPGYYYVDTKLDITSHNEDYTIVEQYERSEGRHHLFL

SEQ ID NO: 312 - protein, 238 aa, Aequorea victoria
MSKGEELFTGVVPILVELDGDVNGHKFSVRGEGEGDATNGKLTLKFICTTGKLPVPWPTLVTTLTYGVLCFSRYPDHMKRHDFFKSAMPEGYVQERTISFKDDGTYKTRAEVKFEGDTLVNRIELKGIDFKEDGNILGHKLEYNFNSHNVYITADKQKNGIKAYFKIRHNVEDGSVQLADHYQQNTPIGDGPVLLPDNHYLSTQSVLSKDPNEKRDHMVLLEFVTAAGITHGMDELYK

SEQ ID NO: 313 - protein, 232 aa, Anemonia sulcata
MASFLTETMPFKTTIEGTVNGHYFKCTGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKAGRWEPCTEIVYEVDGVLRGQSLMALKCPGGRHLTCHLHTTYRSKKPASALKMPGFHFEDHRIEIMEEVEKGKCYKQYEAAVGRYCDAAPSKLGHN

SEQ ID NO: 314 - protein, 231 aa, Entacmaea quadricolor
MSELIKENMHMKLYMEGTVNNHHFKATSEGEGKPYEGTQTMRIKVVEGGPLPFAFDILATSFMYGSRTFINHTQGIPDFFKQSFPEGFTWERVTTYEDGGVLTATQDTSLQDGMLIYNVKIRGVNFPSNGPVMQKKTLGWEANTEMLYPADGGLEGRSDMALKLVGGGHLIVNFKTTYRSKKPAKNLKMPGVYYVDHRLERIKEADKETYVEQHEVAVARYSDLPSKLGHK

SEQ ID NO: 315 - protein, 226 aa, Lobophyllia hemprichii
MSAIKPDMKIKLRMEGNVNGHHFVIDGDGTGKPFEGKQSMDLEVKEGGPLPFAFDILTTAFFYGNRVFAKYPDNIQDYFKQSFPKGYSWERSLTFEDGGICIARNDITMEGDTFYNKVRFYGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 316 - protein, 232 aa, Olindias formosus
MASGRALFQYPMTSKIELNGEINGKKFKVAGEGFTPNSGRFNMHAYCTTGDLPMSWVVIASPLQYGFHMFAHYPEDITHFFQECFPGSYTLDRTLRMEGDGTLTTHHEYSLKDGCVTSKTTLNASGFDPKGATMTKSFVEQLPNQVEITAEGNGIRLTSTVLYLKKDGTIQIGTQDCIVKPVGGKKVTQPKAHFLHTQIIQKKDPNDTRDHIVQTELAVAGNPWHEPSASAV

SEQ ID NO: 317 - protein, 224 aa, Echinophyllia sp. SC22
MSVIKPDMKIKLRMEGAVNGHPFAIEGVGLGKPFEGKQSMDLKVKEGGPLPFAYDILTMAFCYGNRVFAKYPENIVDYFKQSFPEGYSWERSMIYEDGGICIATNDITLDGDCYIYEIRFDGVNFPANGPVMQKRTVKWEPSTEKLYVRDGVLKSDGNYALSLEGGGHYRCDSKTTYKAKKVVQLPDYHDVVHHIEIKSHDRDYSNVNLHEHAEAHSGLPRQAK

SEQ ID NO: 318 - protein, 232 aa, Acropora millepora
MALSKHGLTKDMTMKYHMEGSVDGHKFVITGHGNGNPFEGKQTMNLCVVEGGPLPFSEDILSAAFDYGNRVFTEYPQGMVDFFKNSCPAGYTWHRSLLFEDGAVCTTSADITVSVEENCFYHNSKFHGVNFPADGPVMKKMTTNWEPSCEKIIPVPRQGILKGDIAMYLLLKDGGRYRCQFDTIYKAKSDPKEMPEWHFIQHKLTREDRSDAKNQKWQLVEHAVASRSALPG

SEQ ID NO: 319 - protein, 226 aa, Corynactis californica
MSLSKQVLPRDVKMRFHMDGCVNGHSFTIEGEGTGKPYEGKKTLKLRVTKGGPLPFAFDILSATFTYGNRCFCDYPEEMPDYFKQSLPEGYSWERTMMYEDGACSTASAHISLDKDCFIHNSTFHGVNFPANGPVMQKKAMNWEPSSELITPCDGILKGDVTMFLLQEGGHRHKCQFTTSYKAHKAVKIPPNHIIEHRLVRKEVGDAVQIQEHAVAKHFTVQIKEA

SEQ ID NO: 320 - protein, 234 aa, Obelia sp.
MSSAGALLFTNKIPYVTELEGDVNGMKFTIHGKGTGDASTGHIEAKYVCTSGEIPVPWATLVSTMCYGVQCFAKYPSHIKDFYKSAMPEGYIQERTISFEGDGVYKTRAMVTYERGSIYNRVTLTGENFKKDGHILRKNVAFQCPPSILYILPDTVNNGIRVEFNQVFDIEGETEKLVSSFSQINRPLAESAAVHIPRYHHITYHTKLSKDRDERRDHMCLVEVVKAVDLDTYQ

SEQ ID NO: 321 - protein, 226 aa, Lobophyllia hemprichii
MSAIKPDMKIKLRMEGNVNGHHFVIDGDGTGKPFEGKQSMDLEVKEGGPLPFAFDILTTAFMYGNRVFAKYPDNIQDYFKQSFPKGYSWERSLTFEDGGICIARNDITMEGDTFYNKVRFYGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 322 - protein, 239 aa, Aequorea victoria
MVSKGEELFTGVVPILVELDGDVNGHKFSVRGEGEGDATNGKLTLKLISTTGKLPVPWPTLVTTLGYGLQSFARYPDHMKQHDFFKSAMPEGYVQERTIFFKDDGTYKTRAEVKFEGDTLVNRIELKGIDFKEDGNILGHKLEYNFNSHNVYITADKQKNGIKANFKIRHNVEDGGVQLADHYQQNTPIGDGPVLLPDNHYLSYQSKLSKDPNEKRDHMVLKEFVTAAGITLGMDELYK

SEQ ID NO: 323 - protein, 239 aa, Aequorea victoria
MVSKGEELFTGVVPILVELDGDVNGHKFSVRGEGEGDATNGKLTLKLISTTGKLPVPWPTLVTTLGYGLQSFARYPDHMKQHDFFKSAMPEGYVQERTIFFKDDGTYKTRAEVKFEGDTLVNRIELKGIDFKEDGNILGHKLEYNFNSHNVYITADKQKNGIKANFKIRHNVEDGGVQLADHYQQNTPIGDGPVLLPDNHYLSYQSVLSKDPNEKRDHMVLKEFVTAAGITLGMDELYK

SEQ ID NO: 324 - protein, 239 aa, Aequorea victoria
MVSKGEELFTGVVPILVELDGDVNGHKFSVSGEGEGDATYGKLTLKFICTTGKLPVPWPTLKTTLTWGVQCFARYPDHMKQHDFFKSAMPEGYVQERTIFFKDDGNYKTRAEVKFEGDTLVNRIELKGIDFKEDGNILGHKLEYNAISGNVNITADKQKNGIKANFKIRHNIEDGSVQLADHYQQNTPIGDGPVLLPDNHYLSTQSKQSKDPNEKRDHMVLLEFVTAAGITLGMDELYK

SEQ ID NO: 325 - protein, 224 aa, Sarcophyton sp.
MSVIKEEMKIKLHMEGNVNGHAFVIEGDGKGKPYDGTQTLNLTVKEGAPLPFSYDILTNAFQYGNRAFTKYPADIPDYFKQTFPEGYSWERTMSYEDNAICNVRSEISMEGDCFIYKIRFDGKNFPPNGPVMQKKTLKWEPSTEMMYVRDGFLMGDVNMALLLEGGGHHRCDFKTSYKAKKVVQLPDAHKIDHRIEILSHDRDYSKVKLYENAVARNSLLPSQA

SEQ ID NO: 326 - protein, 239 aa, Aequorea victoria
MVSKGEKLFTGVVPILVELDGDVNGHKFSVSGEGEGDATYGKMSLKFICTTGKLPVPWPTLKTTLTWGMQCFARYPDHMKQHDFFKSAMPEGYVQERTIFFKDDGNYKTRAEVKFEGDTLVNRIELKGVDFKEDGNILGHKLEYNAISGNANITADKQKNGIKAYFTIRHDVEDGSVLLADHYQQNTPIGDGPVLLPDNHYLSTQSKQSKDPNEKRDHMVLLEFVTAAGIPLGADELYK

SEQ ID NO: 327 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFAEYPDHIQDYFKQSFPKGYSWERSLTFEDGGICIARNDITMEGDTFYNKVRFHGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 328 - protein, 222 aa, Pontellina plumata [sequence omitted]

SEQ ID NO: 329 - protein, 238 aa, Aequorea victoria
MSKGAELFNGIVPILIELNGDVHGHKFSVRGEGEGDAGSGKIEIKFVCTTGTLPVPWPTLVTTLCYGVQCFTRYPEHMKQHDFYKSAMPDGYIQKRTISFQDDGHYKTRAEVKFEGDTLVNRIELKGIDFKEDGNILGNKMEYNYNSHSVYVLSDKANNGIKVNFKIRHNLKGEGIQLADHDQQNIPIGDGPVLLPDYHYLSTQTKITKDPNEKRDHMNLVEFVTACGITHGMDELYK

SEQ ID NO: 330 - protein, 240 aa, Clavularia sp
MVSKGEETTMGVIKPDMKIKLKMEGNVNGHAFVIEGEGEGKPYDGTNTVNLEVKEGAPLPFSYDILSNAFQYGNRAFTKYPDDIANYFKQSFPEGYSWERTMTFEDKGIVKVKSDISMEEDSFIYEIRLKGKNFPPNGPVMQKKTLKWEPSTEILYVRDGVLVGDISHSLLLEGGGHYRCDFKTIYKAKKVVKLPDYHFVDHRIEILNHDKDYNKVTLYENAVARYSLLPPQAGMDELYK

SEQ ID NO: 331 - protein, 238 aa, Aequorea victoria
MSKGAELFNGIVPILIELNGDVHGHKFSVRGEGEGDAGSGKIEIKFVCTTGTLPVPWPTLVTTFCYGVQCFTRYPEHMKQHDFYKSAMPDGYIQKRTISFQDDGHYKTRAEVKFEGDTLVNRIELKGIDFKEDGNILGNKMEYNYNSHSVYVLSDKANNGIKVNFKIRHNLKGEGIQLADHDQQNIPIGDGPVLLPDYHYLSTQTAITKDPNEKRDHMNLVEFVTACGITHGMDELYK

SEQ ID NO: 332 - protein, 230 aa, Scolymia cubensis
MSAIKTVVKQFMKIKMSLEGTVNGHYFKIVGEGDGTPFEGKQTLHLKVKEGAPLPFAYDILTTALHYGNRVFVEYPENIPDYFKQSFPKGYSWERSLTFEDGGICIARSDIKMVGDTFHNEVQFYGVNFPANGPVMQRHTVKWEPSTEKIYVRDGVLTGDITMALLLKGGTHYRCDFRTTYKAKEKGPKFPGYHLVDHCIEITSHDKDYNVVELYEHAVAHSGLPDSANR

SEQ ID NO: 333 - protein, 218 aa, Verrillofungia concinna; identical to SEQ ID NO: 69

SEQ ID NO: 334 - protein, 139 aa, Anguilla japonica
MVEKFVGTWKIADSHNFGEYLKAIGAPKELSDGGDATTPTLYISQKDGDKMTVKIENGPPTFLDTQVKFKLGEEFDEFPSDRRKGVKSVVNLVGEKLVYVQKWDGKETTYVREIKDGKLVVTLTMGDVVAVRSYRRATE

SEQ ID NO: 335 - protein, 238 aa, Aequorea victoria
MSKGEELFTGVVPILVELDGDVNGHKFSVSGEGEGDATYGKLTLKFICTTGKLPVPWPTLVTTFAYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 336 - protein, 239 aa, Aequorea victoria
MVSKGEELFTGVVPILVELDGDVNGHKFSVSGEGEGDATYGKLTLKFICTTGKLPVPWPTLVTTLTYGVQCFARYPDHMKQHDFFKSAMPEGYVQERTIFFKDDGNYKTRAEVKFEGDTLVNRIELKGIDFKEDGNILGHKLEYNYNSHKVYITADKQKNGIKVNFKTRHNIEDGSVQLADHYQQNTPIGDGPVLLPDNHYLSTQSKLSKDPNEKRDHMVLLEFVTAAGITLGMDELYK

SEQ ID NO: 337 - protein, 222 aa, Pontellina plumata
MPAMKIECRISGTLNGVVFELVGGGEGIPEQGRMTNKMKSTKGALTFSPYLLSHVMGYGFYHFGTYPSGYENPFLHAANNGGYTNTRIEKYEDGGVLHVSFSYRYEAGRVIGDFKVVGTGFPEDSVIFTDKIIRSNATVEHLHPMGDNVLVGSFARTFSLRDGGYYSFVVDSHMHFKSAIHPSILQNGGSMFAFRRVEELHSNTELGIVEYQHAFKTPTAFA

SEQ ID NO: 338 - protein, 226 aa, Mycedium elephantotus
MSVIKPDMKLKLRMEGTVNGHYFVIEGDGKGRPFEGKQSMDLDVKEGGPLPFAYDILTTAFHYGNRVFAEYPDHIPDYFKQSFPGGYSWERSLTFEDGGICIARNDIKMVGDTFYNTVRFDGVNFPPNGPVMQRRTQKWEPSTEKIYVRDGVLTGDITMALLLEGGVHYRCDFRTTYKAKEKGVQLPGYHFVDHCIEILSHDKDYNKVKLYEHAVAHSGLPDNKRQ

SEQ ID NO: 339 - protein, 226 aa, Lobophyllia hemprichii
MSAIKPDMKIKLRMEGNVNGHHFVIDGDGTGKPFEGKQSMDLEVKEGGPLPFAFDILTTAFLYGNRVFAKYPDNIQDYFKQSFPKGYSWERSLTFEDGGICIARNDITMEGDTFYNKVRFYGTNFPANGPVMQKKTLKWEPSTEKMYVRDGVLTGDIHMALLLEGNAHYRCDFRTTYKAKEKGVKLPGYHFVDHCIEILSHDKDYNKVKLYEHAVAHSGLPDNARR

SEQ ID NO: 340 - protein, 222 aa, Ceriantharia
MNLSKNVSVSVYMKGNVNNHEFEYDGEGGGDPYTGKYSMKMTLRGQNCLPFSYDIITTAFQYGFRVFTKYPEGIVDYFKDSLPDAFQWNRRIVFEDGGVLNMSSDITYKDNVLHGDVWAVGVNFPPNGPVMKNEIVMEEPTEETFTPKNGVLVGFCPKAYLLKDGSYYYGNMTTFYRSKKSGQAPPGYHFVKHRLVKTNVGHGFKTVEQTEYATAHVSDLPK

SEQ ID NO: 341 - protein, 227 aa, Montipora millepora
MALPKQMKLTYHMEGTVNGHFFIIKGEGGGEPYEGTHTIKLQVVEGSPLPFSPDILSTVFQYGNRCFTKYPPNIVDYFKNSCSGGGYTFGRSFLYEDGAVCTASGDITLSSDKSSFEHKSKFLGVNFPADGPVMKKETTNWEPSCEKMTPNGMTLIGDVTEFLLKKDGKRYKCQFHTFHDAKEKSRNMPMPDFHFVQHEIERKDLPGPMQTWQLTEHAAACKNCFTE

SEQ ID NO: 342 - protein, 234 aa, Entacmaea quadricolor
MVSKGEELIKENMRSKLYLEGSVNGHQFKCTHEGEGKPYEGKQTNRIKVVEGGPLPFAFDILATMFMYGSKVFIKYPADLPDYFKQSFPEGFTWERVMVFEDGGVLTATQDTSLQDGELIYNVKLRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 343 - protein, 225 aa, Discosoma sp.
MDSTENVIKPFMRFKVHMEGSVNGHEFEIEGEGEGKPYEGTHTVKLQVTKGGPLPFAWDILSPQFQYGSKVYVKHPADIPDYKKLSFPEGFKWERVMNFEDGGVVTVTQDSSLQDGTFIYHVKFIGVNFPSDGPVMQKKTLGWEPSTERLYPRDGVLKGEIHKALKLKGGGHYLVEFKSIYMAKKPVKLPGYYYVDSKLDITSHNEDYTVVEQYERTEGRHHLFQ

SEQ ID NO: 344 - protein, 221 aa, Corynactis californica
MSLSKQVVKEDMKMTYHMDGCVNGHYFTIEGEGTGKPFKGQKTLKLRVTEGGPLPFAFDILSATFTYGNRCFCDYPEDMPDYFKQSLPEGYSWERTMMYEDGACGTASAHISLDKNGFVHNSTFHGVNFPANGPVMKKKGVNWEPSSEKITACDGILKGDVTMFLVLEGGHRLKCLFQTTYKADKVVKMPPNHIIEHRLVRSEDGDAVQIQEHAVAKYFTV

SEQ ID NO: 345 - protein, 237 aa, Zoanthus sp.
MVSKGEGQSKHGLKEEMTVKYHMEGCVNGHKFVITGEGIGNPFKGKQTANLCVIEGGPLPFSEDILSPGFKYGDRIFTEYPQDIVDYFKNSCPAGYTWERSYLFEDGAVCRCNVDITVSEKENCIYHKSIFRGVNFPADGPVMKKMTTNWEASTEKIVPVPKQGILKGKVKMCLLLKDGGRYHCQFDTVYKAKSVPSKMPEWHFIQHKLLREDRSDAKNQKWQLTEHAIAGMDELYK

SEQ ID NO: 346 - protein, 239 aa, Aequorea victoria
MVSKGEELFTGVVPILVELDGDVNGHKFSVRGEGEGDATNGKLTLKFISTTGKLPVPWPTLVTTLSWGVQSFARYPDHMKQHDFFKSAMPEGYVQERTIFFKDDGTYKTRAEVKFEGDTLVNRIELKGIDFKEDGNILGHKLEYNAIHGNVYITADKQKNGIKANFGLNCNVEDGSVQLADHYQQNTPIGDGPVLLPDNHYLSTQSKLSKDPNEKRDHMVLLEFVTAAGITLGMDELYK

SEQ ID NO: 347 - protein, 238 aa, Aequorea victoria
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 348 - protein, 227 aa, Mycedium elephantotus
MSVIKTDMKIRLQMQGAVNGHPFVITGEGEGKPYEGKHTINLTVQDGGPLPFAFDILTTAFQYGNRVFTKYPKDIPDYFKQSFPAGYSWERCMTFEDGGLCTVSSHIKIEGDYFTYDIRFHGVNFPAGGPVMQKKTLRWEPSTENMYVRDGVLVGEVERTLLLEGNKHHRCNFRTTYKAKKEVVLPEYHFVDHRIEILGHDKDYNNVVVYENAVARQQASTLPSKAK

SEQ ID NO: 349 - protein, 238 aa, Aequorea victoria
MSKGEELFTGVVPILVELDGDVNGHKFSVSGEGEGDATYGKLTLKFICTTGKLPVPWPTLVTTFGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 350 - protein, 239 aa, Aequorea victoria
MVSKGEELFTGVVPILVELDGDVNGHKFSVSGEGEGDATYGKLTLKFICTTGKLPVPWPTLVTTLTYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSTQSKLSKDPNEKRDHMVLLQFVTAAGITLGMDELYK

SEQ ID NO: 351 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNAIHGNVYITADKQKNGIKANFGLNCNIEDGSVQLADHYQQNTPIGDGPVLLPDNHYLSTQSKLSKDPNEKRDHMVLLEFVTAAGITLGMDELYK

SEQ ID NO: 352 - protein, 236 aa, Clavularia sp.
MVSKGEETTMGVIKPDMKIKLKMEGNVNGHAFVIEGEGEGKPYDGTNTINLEVKEGAPLPFSYDILTTAFAYGNRAFAKYPDDIPNYFKQSFPEGYSWERTMTFEDKGIVKVKSDISMEEDSFIYEIHLKGENFPPNGPVMQKMTTGWDASTERMYVRDGVLKGDVKMKLLLEGGGHHRVDFKTIYRAKKAVKLPDYHFVDHRIEILNHDKDYNKVTVYESAVARNSTDGMDELYK

SEQ ID NO: 353 - protein, 239 aa, Aequorea victoria
MVSKGEELFTGVVPILVELDGDVNGHKFSVSGEGEGDATYGKLTLKFICTTGKLPVPWPTLLTTIGYGLMCFARYPDHMKQHDFFKSAMPEGYVQERTIFFKDDGNYKTRAEVKFEGDTLVNRIELKGIDFKEDGNILGHKLEYNHDSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 354 - protein, 225 aa, Galaxea fascicularis
MSVIKPEMKIKLCMRGTVNGHNFVIEGEGKGNPYEGTQILDLNVTEGAPLPFAYDILTTVFQYGNRAFTKYPADIQDYFKQTFPEGYHWERSMTYEDQGICTATSNISMRGDCFFYDIRFDGTNFPPNGPVMQKKTLKWEPSTEKMYVRDGVLKGDVNMALLLEGGGHYRCDFKTTYKAKKDVRLPDAHKVDHRIEILKHDKDYNKVKLYENAVARYSMLPSQAK

SEQ ID NO: 355 - protein, 239 aa, Aequorea victoria
MVSKGEELFTGVVPILVELDGDVNGHKFSVSGEGEGDATYGKLTLKFICTTGKLPVPWPTLVTTLTYGVQCFARYPDHMKQHDFFKSAMPEGYVQERTIFFKDDGNYKTRAEVKFEGDTLVNRIELKGIDFKEDGNILGHKLEYNYNHHKVYITADKQKNGIKVNFKTRHNIEDGSVQLADHYQQNTPIGDGPVLLPDNHYLHTHSKLSKDPNEKRDHMVLLEFVTAAGITLGMDELYK

SEQ ID NO: 356 - protein, 239 aa, Aequorea victoria
MVSKGEELFTGVVPILVELDGDVNGHKFSVSGEGEGDATYGKLTLKFISTTGKLPVPWPTLVTTLTYGVQMFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 357 - protein, 239 aa, Aequorea victoria
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSKLSKDPNEKRDHMVLLEFVTAAGITLGMDELYK

SEQ ID NO: 358 - protein, 231 aa, Acropora nobilis
MSYSKQGIAQVMKTKYHMEGSVNGHEFTIEGVGTGNPYEGTQMSELVITKPAGKPLPFSFDILSTVFQYGNRCFTKYPEGMTDYFKQAFPDGMSYERSFLYEDGGVATAGWNIGLERDCFIHKSIYHGVNFPADGPVMKKKTIGWDKAFEKMTVSKDVLRGDVTGFLMLEGGGYHSCQFHSTYKPEKPAALPPNHVVEHHIVRTDLGQSAKGFTVKLEEHAAAHVNPLKVQ

SEQ ID NO: 359 - protein, 223 aa, Verrillofungia concinna
MSVIKPEMKMKYFMDGSVNGHEFTVEGEGTGKPYEGKHKITLDVTKGGPLPFAFDLLSTVFSYGNRCLTKYPDDIPDYFKQCFPGGYSWERKFEFEDGGLAIAKAEISLKGNCFEHKSTIEGTFPDSSPIAQNKTLGWEPSTEKMTVRDGSMKGDDAAYLKLVGGGNHKCYFTTTYTAKKKIPNLPQSHFIGHRISSVVNGTKIGVMEDAIAHLYPFNGVPCQ

SEQ ID NO: 360 - protein, 231 aa, Entacmaea quadricolor; identical to SEQ ID NO: 91

SEQ ID NO: 361 - protein, 233 aa, Entacmaea quadricolor; identical to SEQ ID NO: 52

SEQ ID NO: 362 - protein, 133 aa, Trichodesmium erythraeum IMS101
MAKTSEQRVNIATLLTENKKKIVDKASQDLWRRHPDLIAPGGIAFSQRDRALCLRDYGWFLHLITFCLLAGDKGPIESIGLISIREMYNSLGVPVPAMMESIRCLKEASLSLLDEEDANETAPYFDYIIKAMS

SEQ ID NO: 363 - protein, 231 aa, Entacmaea quadricolor
MSELIKENMHMKLYMEGTVNNHHFKCTSEGEGKPYEGTQTMRIKVVEGGPLPFAFDILATSFMYGSKTFINHTQGIPDFFKQSFPEGFTWERVTTYEDGGVLTATQDTSLQDGCLIYNVKIRGVNFPSNGPVMQKKTLGWEAATEMLYPADGGLEGRSDMALKLVGGGHLICNLKTTYRSKKPAKNLKMPGVYYVDRRLERIKEADKETYVEQHEVAVARYCDLPSKLGHK

SEQ ID NO: 364 - protein, 239 aa, Aequorea victoria
MVSKGEELFTGVVPILVELDGDVNGHKFSVSGEGEGDATYGKLTLKFICTTGKLPVPWPTLVTTLTYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 365 - protein, 239 aa, Aequorea victoria
MVSKGEELFTGVVPILVELDGDVNGHKFSVSGEGEGDATYGKLTLKFICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 366 - protein, 236 aa, Discosoma sp.
MVSKGEENNMAIIKEFMRFKVHMEGTVNGHEFEIEGEGEGHPYEGFQTAKLKVTKGGPLPFAWDILSPLITYGSKAYVKHPADIPDYFKLSFPEGFKWERVMNYEDGGVVTVTQDSSLQDGEFIYKVKMRGTNFPSDGPVMQKKTMGWEASSERMYPEDGALKGEIRMRLKLKDGGHYTSEVKTTYKAKKSVLLPGAYIVGIKLDITSHNEDYTIVEQYERSEARHSTGGMDELYK

SEQ ID NO: 367 - protein, 229 aa, Eusmilia fastigiat
MSFSKQVLNDVTMTYFMEGSVNGHDFTIEGEGTGKPYEGHQRFNLRVTKGAPLPFAVDILSAAFAYGNRCFTKYPKEIPDFFKQSLPEDMSWERTMTFEDGGIVAISAHIRLIGNRFEHKSKFVGVNFPADGPVMQRKTLGWEPSSEKMTPRDGILKGYVPSFLVLQGGGNYRCDYDTSYRAMKPVEMPGGHFIQHRIVRRDIKKDSNGNTWQIQEDAFAHNSEVPDSA

SEQ ID NO: 368 - protein, 218 aa, Verrillofungia concinna
MVSVIKPEMKMRYYMDGSVNGHEFTIEGEGTGRPYEGHQEMTLRVTMAKGGPMPFAFDLVSHVFCYGHRPFTKYPEEIPDYFKQAFPEGLSWERSLEFEDGGSASVSAHISLRGNTFYHKSKFTGVNFPADGPIMQNQSVDWEPSTEKITASDGVLKGDVTMYLKLEGGGNHKCQFKTTYKAAKKILKMPGSHYISHRLVRKTEGNITELVEDAVAHS

SEQ ID NO: 369 - protein, 289 aa, Trichodesmium erythraeum IMS101
MAKTSEQRVNIATLLTENKKKIVDKASQDLWRRHPDLIAPGGIAFSQRDRALCLRDYGWFLHLITFCLLAGDKGPIESIGLISIREMYNSLGVPVPAMMESIRCLKEASLSLLDEEDANETAPYFDYIIKAMSGHGTGSTGSGSSGTASSEDNNMAMAKTSEQRVNIATLLTENKKKIVDKASQDLWRRHPDLIAPGGIAFSQRDRALCLRDYGWFLHLITFCLLAGDKGPIESIGLISIREMYNSLGVPVPAMMESIRCLKEASLSLLDEEDANETAPYFDYIIKAMS

SEQ ID NO: 370 - protein, 234 aa, Entacmaea quadricolor
MVSKGEELIKENMRSKLYLEGSVNGHQFKCTHEGEGKPYEGKQTNRIKVVEGGPLPFAFDILATHFMYGSKVFIKYPADLPDYFKQSFPEGFTWERVMVFEDGGVLTATQDTSLQDGELIYNVKVRGVNFPANGPVMQKKTLGWEPSTETMYPADGGLEGRCDKALKLVGGGHLHVNFKTTYKSKKPVKMPGVHYVDRRLERIKEADNETYVEQYEHAVARYSNLGGGMDELYK

SEQ ID NO: 371 - protein, 239 aa, Aequorea victoria
MVSKGEELFTGVVPILVELDGDVNGHKFSVSGEGEGDATYGKLTLKFICTTGKLPVPWPTLVTTLTYGVQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSTQSALSKDPNEKRDHMVLLEFVTAAGITLGMDELYK

SEQ ID NO: 372 - protein, 220 aa, Branchiostoma floridae
MPLPATHDIHLHGSINGHEFDMVGGGKGDPNAGSLVTTAKSTKGALKFSPYLMIPHLGYGYYQYLPYPDGPSPFQASMLEGSGYAVYRVFDFEDGGKLTTEFKYSYEGSHIKADMKLMGSGFPDDGPVMTSQIVDQDGCVSKKTYLNNNTIVDSFDWSYNLQNGKRYRARVSSHYIFDKPFSADLMKKQPVFVYRKCHVKASKTEVTLDEREKAFYELAG

SEQ ID NO: 373 - protein, 223 aa, Cerianthus sp.
MSQFPEYLPVTVHMRGNVNNLEFEYDGEGGGDPRAGQFTMNMQLRGRKPLPFSYDIITTGFQYGVRAFTKYPDSIADYFKGSFPEAFQWNRRIEFEDGGVINMSSDITFKDNRVYGDVWALGVNFPPNGPVMKNEIVMEEPAEETLIPQNGVLVGFCPKAYLLKDGSYYYGKMTTFYRSKKSGQALPGFHFIQHRLVKTKVEPGFKMVEQSEYATAFVSDLPK

SEQ ID NO: 374 - protein, 230 aa, Psammocora sp. NA-2008
MASTKNVLPNMMTLTYHMEGSVNGHNFEIIGEGTGNPKEGKHTITLQVVKGGPLPFSVDILSTVFQYGNRCFTKYPPNTVDYFKNSCPPGYTFERSFLYEDGAVCTASGDITLSDDKASFHHKSKFFGVNFPDDGPVMKKKTTDWEPSCEKMTPSGKTLKGDVIEFLLLEGGGRYKCQFHTVYRAKTEPKRMPEFHFVQHKLTRTDVSDPLKQQWQLTEDAAACESCFHK

SEQ ID NO: 375 - protein, 225 aa, Discosoma sp.
MDSTENVIKPFMRFKVHMEGSVNGHEFEIEGVGEGKPYEGTQTAKLQVTKGGPLPFAWDILSPQFFYGSKAYIKHPADIPDYLKQSFPEGFKWERVMNFEDGGVVTVTQDSSLQDGTLIYHVKFIGVNFPSDGPVMQKKTLGWEPSTERNYPRDGVLKGENHMALKLKGGGHYLCEFKSIYMAKKPVKLPGYHYVDYKLDITSHNEDYTVVEQYERAEARHHLFQ

SEQ ID NO: 376 - protein, 232 aa, Entacmaea quadricolor
MVSELIKENMPMKLYMEGTINNHHFKCTSEGEGKPYEGTQTMRIKVVEGGPPPFAFDILATSFMYGSRTFIKHPPGIPDFFKQSFPEGFTWERVTTYEDGGVLTATQDTSLQDGCLIYNVKVRGVNFPANGPVMQKKTLGWEASTETMYPADGGLEGACDMALKLVGGGHMICNLETTYRSKKPATNLKMPGVYNVDHRLERIKEADDETYVEQHEVAVARYSTGGAGDGGK

SEQ ID NO: 377 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAIHGNVYITADKQKNGIKANFGLNCNIEDGSVQLADHYQQNTPIGDGPVLLPDNHYLSTQSKLSKDPNEKRDHMVLLEFVTAAGITLGMDELYK

SEQ ID NO: 378 - protein, 231 aa, Entacmaea quadricolor
MSELIKENMHMKLYMEGTVNNHHFKCTSEGEGKPYEGTQTMRIKVVEGGPLPFAFDILATSFMYGSSTFINHTQGIPDFWKQSFPEGFTWERVTTYEDGGVLTATQDTSLQDGCLIYNVKIRGVNFPSNGPVMKKKTLGWEPSTEMLYPADGGLEGVVNMALKLVGGGHLICNFKTTYRSKKPAKNLKMPGVYYVDRRLEQIKEADKETYWEQHEVAVARYCDLPSKLGHK

SEQ ID NO: 379 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSDNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 380 - protein, 238 aa, Aequorea coerulescens; identical to SEQ ID NO: 64

SEQ ID NO: 381 - protein, 239 aa, Aequorea coerulescens
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 382 - protein, 230 aa, Dendronephthya sp.
MNTPGINLIKEDMRVKVHMEGNVNGHAFVIEGEGKGKPYEGTQTANLTVKEGAPLPFSYDILTTAVHYGNRVFTKYPEDIPDYFKQSFPEGYSWERTMTFEDKGICTIRSDISLEGDCFFQNVRFKGTNFPPNGPVMQKKTLKWEPSTEKLHVRDGLLVGNINMALLLEGGGHYLCDSKTTYKAKKVVQLPDAHFVDHRIEILGNDSDYNKVKLYEHAVARYSPLPSQVW

SEQ ID NO: 383 - protein, 239 aa, Aequorea victoria
MVSKGEELFTGVVPILVELDGDVNGHKFSVSGEGEGDATYGKLTLKFVCTTGKLPVPWPSLLTTIGYGLMCFARYPDHMKQHDFFKSAMPEGYVQERTIFFKDDGNYKTRAEVKFEGDTLVNRIELKGIDFKEDGNILGHKLEYNHDSHNVYITADKQKNGIKVNFKIRHNIEDGSVQLADHYQQNTPIGDGPVLLPDNHYLSYQSALGKDPNEKRDHMVLLEFVTAAGITLGTDELYK

SEQ ID NO: 384 - protein, 231 aa, Acropora millepora
MSYSKQGIAQVMKTKYHMEGSVNGHEFTIEGVGTGNPYEGTQMSELVITKPAGKPLPFSFDILSTVFQYGNRCFTKYPEGMTDYFKQAFPDGMSFERSFLYEDGGVATASWNIRLERDCFIHKSIYHGVNFPADGPVMKKKTIGWDKAFEKMTVSKDVLRGDVTEFLMLEGGGYHSCQFHSTYKPEKPVTLPPNHVVEHHIVRTDLGQTAKGFTVKLEEHAAAHVNPLKVQ

SEQ ID NO: 385 - protein, 240 aa, Clavularia sp.
MVSKGEETTMGVIKPDMKIKLKMEGNVNGHAFVIEGEGEGKPYDGTNTVNLEVKEGAPLPFSYDILSNAFQYGNRAFTKYPDDIADYFKQSFPEGYSWERTMTFEDKGIVKVKSDISMEEDSFIYEIRLKGKNFPPNGPVMQKKTLKWEPSTEILYVRDGVLVGDISHSLLLEGGGHYRCDFKTIYKAKKVVKLPDYHFVDHRIEILNHDKDYNKVTLYENAVARYSLLPSQAGMDELYK

SEQ ID NO: 386 - protein, 231 aa, Entacmaea quadricolor
MSELIKENMHMKLYMEGTVNNHHFKCTSEGEGKPYEGTQTMRIKVVEGGPLPFAFDILATSFMYGSSTFINHTQGIPDFFKQSWPEGFTWERVTTYEDGGVLTATQDTSLQDGCLIYNVKIRGVNFPSNGPVMKKKTLGWEPSTEMLYPADGGLGGVVDMALKLVGGGHLICNFKTTYRSKKPAKNLKMPGVYYVDRRLEIIKEADKETYWEQHEVAVARYCDLPSKLGHK

SEQ ID NO: 387 - protein, 239 aa, Aequorea victoria
MVSKGEELFTGVVPILVELDGDVNGHKFSVSGEGEGDATYGKLTLKFICTTGKLPVPWPTLVTTFSYGVMVFARYPDHMKQHDFFKSAMPEGYVQERTIFFKDDGNYKTRAEVKFEGDTLVNRIELKGIDFKEDGNILGHKLEYNFNSHNVYIMADKQKNGIKANFKIRHNIEDGGVQLADHYQQNTPIGDGPVLLPDNHYLSIQSKLSKDPNEKRDHMVLLEFVTAAGITLGMDELYK

SEQ ID NO: 388 - protein, 236 aa, Discosoma sp.
MVSKGEEDNMAIIKEFMRFKVHMEGSVNGHEFEIEGEGEGRPYEGTQTAKLKVTKGGPLPFAWDILSPQFCYGSKAYVKHPADIPDYLKLSFPEGFNWERVMNLEDGGVVTVTQDSSLQDGEFIYKVKLRGTNFPSDGPVMQCRTVGWEASTERMHPEDGALKGEIMQRLKLKDGGHYDAEVKTTYKAKKPVQLPGAYNVDIKLDITSHNEDYTIVELYERAEGRHSTGGMDELYK

SEQ ID NO: 389 - protein, 239 aa, Aequorea victoria
MVSKGEELFTGVVPILVELDGDVNGHKFSVSGEGEGDATYGKLTLKFICTTGKLPVPWPTLVTTLTYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 390 - protein, 232 aa, Entacmaea quadricolor
MVSELIKENMHMKLYMEGTVNNHHFKATSEGEGKPYEGTQTMRIKAVEGGPLPFAFDILATSFMYGSKTFINHTQGIPDFFKQSFPEGFTWERVTTYEDGGVLTATQDTSLQDGMLIYNVKIRGVNFPSNGPVMQKKTLGWEASTETLYPADGGLEGRADMALKLVGGGHLIANLKTTYRSKKPAKNLKMPGVYYVDRRLERIKEADKETYVEQHEVAVARYSDLPSKLGHR

SEQ ID NO: 391 - protein, 239 aa, Aequorea victoria
MVSKGEELFTGVVPILVELDGDVNGHKFSVSGEGEGDATYGKLTLKFICTTGKLPVPWPTLVTTLGYGVQCFSRYPDHMKQHDFFKSAMPEGYVQERTIFFKDDGNYKTRAEVKFEGDTLVNRIELKGIDFKEDGNILGHKLEYNMNSHNVYIMADKQKNGIKVNYKIRHNIEDGSVQLADHYQQNTPIGDGPVLLPDNHYLSTQSALSKDPNEKRDHMVLLEFVTAAGITLGMDELYK

SEQ ID NO: 392 - protein, 239 aa, Aequorea victoria
MVSKGEELFTGVVPILVELDGDVNGHKFSVRGEGEGDATNGKLTMKFICTTGKLPVPWPTLVTTLTYGVLCFARYPDHMKQHDFFKSAMPEGYVQERTISFEDDGYYKTRAEVKFEGDTLVNRIELKGIDFKEDGNILGHKLEYNFNSHDAYITADKQKNGIRSNFKIRLNVEDGSVQLADHYQQNTPIGDGPVLLPDNHYLSTQNKLSKDPNEKRDHMVLLEFVTASGITLGMDELYK

SEQ ID NO: 393 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFVEYPDHIQDYFKQSFPKGYSWERSLTFEDGGICIARNDITMEGDTFYNKVRFHGTNFPANGPVMQKKTLKWEPSTEIMYVRDGVLTGDIHMALLLEGNAHYRCDSRTTYKAKEKGVKLPGAHFVDHCIEILSHDKDYNKVKLYEHAVAHSGLPDNARR

SEQ ID NO: 394 - protein, 236 aa, Clavularia sp.
MVSKGEETTMGVIKPDMKIKLKMEGNVNGHAFVIEGEGEGKPYDGTNTINLEVKEGAPLPFSYDILTTAFAYGNRAFTKYPDDIPNYFKQSFPEGYSWERTMTFEDKGIVKVKSDISMEEDSFIYEIHLKGENFPPNGPVMQKMTTGWDASTERMYVRDGVLKGDVKMKLLLEGGGHHRVDFKTIYRAKKAVKLPDYHFVDHRIEILNHDKDYNKVTVYESAVARNSTDGMDELYK

SEQ ID NO: 395 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYISDNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 396 - protein, 230 aa, Dendronephthya sp.
MNTPGINLIKEDMRVKVHMEGNVNGHAFVIEGEGKGKPYEGTQTAQLTVKEGAPLPFSYDILTTAVHYGNRVFTKYPEDIPDYFKQSFPEGYSWERTMTFEDKGIATIRSDISLEGDTFFQNVRFKGTNFPPNGPVMQKKTLKWEPSTEKLHVRDGLLVGNINMALLLEGGGHYLADFKTTYKAKKVVQLPDAHFVDHRIEILGQDSDYNKVKLYEHAVARYSPLPSQVW

SEQ ID NO: 397 - protein, 231 aa, Entacmaea quadricolor
MSELIKENMHMKLYMEGTVNNHHFKCTSEGEGKPYEGTQTMRIKVVEGGPLPFAFDILATSFMYGSSTFINHTQGIPDFFKQSWPEGFTWERVTTYEDGGVLTATQDTSLQDGCLIYNVKIRGVNFPSNGPVMKKKTLGWEPSTEKLKPADGGLEGRVDMALKLVGGGHLICNFKTTYRSKKPAKNLKMPGVYYVDRRLEIIKEADKETYWEQHEVAVARYSDLPSKLGHK

SEQ ID NO: 398 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYISGNVYITADKQKNGIKANFKIRHNIEDGGVQLADHYQQNTPIGDGPVLLPDNHYLSTQSALSKDPNEKRDHMVLLEFLTAAGITLGMDELYK

SEQ ID NO: 399 - protein, 232 aa, Acropora sp. #30; identical to SEQ ID NO: 55

SEQ ID NO: 400 - protein, 236 aa, Discosoma
MVSKGEENNVAIIKEFMRFKVHMEGSVNGHEFEIEGEGEGRPYEGTQTAKLKVTKGGPLPFAWDILSPQFLFGSKVYIKHPADIPDYFKLSFPEGFKWERVMNFEDGGVVTVTQDSSLQDGVFIYKVKLRGTNFPSDGPVMQKKTMGWEAFSERMYPEDGALKSEIKTRLKLKDGGHYDAEVKTTYKAKKPVQLPGAYNVNIKLDIVSHNEDYTIVEQYERAEGRHSTGGMDELYK

SEQ ID NO: 401 - protein, 232 aa, Entacmaea quadricolor
MVSELIKENMPMKLYMEGTVNNHHFKCTSEGEGKPYEGTQTMRIKVVEGGPLPFAFDILATSFMYGSRTFIKHPPGIPDFFKQSFPEGFTWERVTTYEDGGVLTATQDTSLQDGCLIYNVKVRGVNFPANGPVMQKKTLGWEASTETMYPADGGLEGACDMALKLVGGGHMICNLETTYRSKKPATNLKMPGVYNVDHRLERIKEADDETYVEQHEVAVARYSTGGAGDGGK

SEQ ID NO: 402 - protein, 231 aa, Acropora nobilis
MSYSKQGIAQVMKTKYHMEGSVNGHEFTIEGVGTGNPYEGTQMSELVITKPAGKPLPFSFDILSTVFQYGNRCFTKYPEGMTDYFKQAFPDGMSYERSFLYEDGGVATASWNIRLERDCFIHKSIYHGVNFPADGPVMKKKTIGWDKAFEKMTVSKDVLRGDVTEFLMLEGGGYHSCQFHSTYKPEKPAALPPNHVVEHHIVRTDLGQSAKGFTVKLEEHAAAHVNPLKVQ

SEQ ID NO: 403 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 404 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAIHGNVYITADKQKNGIKANFGLNCNIEDGSVQLADHYQQNTPIGDGPVLLPDNHYLSIQSKLSKDPNEKRDHMVLLEFVTAAGITLGMDELYK

SEQ ID NO: 405 - protein, 236 aa, Discosoma sp.
MVSKGEENNMAIIKEFMRFKVRMEGSVNGHEFEIEGEGEGRPYEGFQTVKLKVTKGGPLPFAWDILSPQFTYGSKAYVKHPADIPDYLKLSFPEGFKWERVMNFEDGGVVTVTQDSSLQDGEFIYKVKLRGTNFPSDGPVMQKKTMGMEASSERMYPEDGALKGEDKLRLKLKDGGHYTSEVKTTYKAKKPVQLPGAYIVDIKLDITSHNEDYTIVEQYERAEGRHSTGGMDELYK

SEQ ID NO: 406 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNDFHGNVYITADKQKNGIKANFGLNCNIEDGSVQLADHYQQNTPIGDGPVLLPDNHYLSTQSKLSKDPNEKRDHMVLLEFVTAAGITLGMDELYK

SEQ ID NO: 407 - protein, 239 aa, Aequorea victoria
MVSKGEELFTGVVPILVELDGDVNGHKFSVSGEGEGDATYGKLTLKFICTTGKLPVPWPTLVTTLSWGVQCFSRYPDHMKQHDFFKSAMPEGYVQERTIFFKDDGNYKTRAEVKFEGDTLVNRIELKGIDFKEDGNILGHKLEYNYISGNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 408 - protein, 226 aa, Lobophyllia hemprichii
MSAIKPDMKINLRMEGNVNGHHFVIDGDGTGKPFEGKQSMDLEVKEGGPLPFAFDILTTAFHYGNRVFVEYPDHIQDYFKQSFPKGYSWERSLTFEDGGICIARNDITMEGDTFYNKVRFHGTNFPANGPVMQKKTLKWEPSTEKMYVRDGVLTGDIHMALLLEGNAHYRCDSRTTYKAKEKGVKLPGYHLVDHCIEILSHDKDYNKVKLYEHAVAHSGLPDNARR

SEQ ID NO: 409 - protein, 244 aa, Entacmaea quadricolor
MVSKGEELIKENMHTKLYMEGTVNNHHFKCTHEGEGKPYEGTQTNRIKVVEGGPLPFAFDILATCFMYGSKTFINHTQGIPDFFKQSFPEGFTWERVTTYEDGGVLTVTQDTSLQDGCLIYNVKLRGVNFPSNGPVMQKKTLGWEASTETLYPADGGLEGRCDMALKLVGGGHLHCNLKTTYRSKKPAKNLKMPGVYFVDRRLERIKEADNETYVEQHEVAVARYCDLPSKLGHKLNGMDELYK

SEQ ID NO: 410 - protein, 231 aa, Acropora aculeus
MSLSKHGITQEMPTKYHMKGSVNGHEFEIEGVGTGHPYEGTHMAELVIIKPAGKPLPFSFDILSTVIQYGNRCFTKYPADLPDYFKQAYPGGMSYERSFVYQDGGIATASWNVGLEGNCFIHKSTYLGVNFPADGPVMTKKTIGWDKAFEKMTGFNEVLRGDVTEFLMLEGGGYHSCQFHSTYKPEKPVELPPNHVIEHHIVRTDLGKTAKGFMVKLVQHAAAHVNPLKVQ

SEQ ID NO: 411 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAIHGNVYITADKQKNGIKANFGLRHNIEDGSVQLADHYQQNTPIGDGPVLLPDNHYLSTQSKLSKDPNEKRDHMVLLEFVTAAGITLGMDELYK

SEQ ID NO: 412 - protein, 234 aa, Obelia sp.
MSSAGALLFTNKIPYVTELEGDVNGMKFTIHGKGTGDASTGNIEAKYVCTSGEIPVPWATLVSTLSYGVQCFAKYPSHIKDFFKSAMPEGYTQERTISFEGDGVYKTRAMVTYERGSIYNRVTLTGENFKKDGHILRKNVAFQCPPDMVYILPDTVNNGIRVEFNQAYDIEGVTEKLVTKCSQMNRPLAGSAAVHIPRYHHLSKHTKLSKDRDERRDHMCLVEVVKAVDLDTYQ

SEQ ID NO: 413 - protein, 244 aa, Entacmaea quadricolor [sequence omitted]

SEQ ID NO: 414 - protein, 241 aa, Aequorea australis
MKIYCEGEKLFKGIVPIQIELNGDVNGHKFSVHGEGQGEAEMGRLTLRFVCTTGKMPVPWPTLVTTFSYGVQCFSRYPEHMKMHDFFKSAMPEGYTQERTIFFDKDGTYKTRAEVKFEGDTLVNRIELTGTGFKEDGNILGHKMEYNYNSHNVYIMSDKAKNGIKVNFKIRHNIEDGTVQLADHYQANYPLGKGPVLLPEDHYLSTQSALTKDPHETRDHMLLLEFVTAAGITHGMDELYK

SEQ ID NO: 415 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAIGGNVYITADKQKNGIKANFKIRHNIEDGSVQLADHYQQNTPIGDGPVLLPDNHYLSTQSKLSKDPNEKRDHMVLLEFVTAAGITLGMDELYK

SEQ ID NO: 416 - protein, 223 aa, Branchiostoma floridae
MSLPTTHDLHIFGSVNGAEFDLVGGGKGNPNDGTLETSVKSTRGALPCSPLLIGPNLGYGFYQYLPFPGGASPFQTAITDGGYQVHRVFKFEDGGVLSCNFRYTYEGGKIKGEFQLIGSGFPAGGPVMSGGLTTLDRSVAKLQCSDDCTITGTNNWSFCTTDGKRHQADVQTNYTFAKPLPAGLKEKMPIFLGHQIEVKASKTEITLSEKVKAFIDTVGSGTG

SEQ ID NO: 417 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNGISDNVYITADKQKNGIKANFKIRHNIEDGSVQLADHYQQNTPIGDGPVLLPDNHYLSTQSALSKDPNEKRDHMVLLEFVTAAGITLGMDELYK

SEQ ID NO: 418 - protein, 239 aa, Aequorea victoria
MASKGEELFTGVVPILVELDGDVNGHKFSVSGEGEGDATYGKLTLKFICTTGKLPVPWPTLVTTLCYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKTRHNIEDGSVQLADHYQQNTPIGDGPVLLPDNHYLSTQSALSKDPNEKRDHMVLLEFVTAAGITHGMDELYN

SEQ ID NO: 419 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNAIHGNVYITADKQKNGIKANFGLNCNIEDGSVQLADHYQQNTPIGDGPVLLPDNHYLSIQSKLSKDPNEKRDHMVLLEFVTAAGITLGMDELYK

SEQ ID NO: 420 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 421 - protein, 225 aa, Discosoma sp.
MDSTENVIKPFMRFKVHMEGSVNGHEFEIEGEGEGKPYEGTQTAKLQVTKGGPLPFAWDILSPQFTYGSKAYVKHPADIPDYKKLSFPEGFKWERVMNFEDGGVVTVTQDSSLQDGTFIYHVKFIGVNFPSDGPVMQKKTLGWEPSTERLYPRDGVLKGEIHKALKLKGGGHYLVEFKTIYMAKKPVKLPGYYYVDSKLDITSHNEDYTVVEQYERAEARHHLFQ

SEQ ID NO: 422 - protein, 152 aa, Chroococcidiopsis
MANREVVETLKELLADGEKRVQVAGVIGTNAAEVVKTAVSLLFQEYPELVSPGGCAYTTRRYNMCVRDMNYFLRMCSYAIVAGGASVLDGRMLAGFRDTFNSLGIPLCPAARGIQLMKKIVKEKLATAGMTNIAFVDEPFDYIARVISETEI

SEQ ID NO: 423 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAIGGNVYITADKQKNGIKANFGLRHNIEDGSVQLADHYQQNTPIGDGPVLLPDNHYLSTQSKLSKDPNEKRDHMVLLEFVTAAGITLGMDELYK

SEQ ID NO: 424 - protein, 238 aa, Aequorea victoria
MSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 425 - protein, 238 aa, Aequorea victoria
MSKGEELFTGVVPILVELDGDVNGHKFSVSGEGEGDATYGKLTLKFICTTGKLPVPWPTLVTTFSYGVQCFARYPDHMKQHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSIQSALSKDPNEKRDHMVLLEFVTAAGITLGMDELYK

SEQ ID NO: 426 - protein, 239 aa, Aequorea victoria
MVSKGEELFTGVVPILVELDGDVNGHKFSVSGEGEGDATYGKLTLKFICTTGKLPVPWPTLVTTLAYGVLCFSRYPDHMKQHDFFKSAMPEGYVQERTIFFKDDGNYKTRAEVKFEGDTLVNRIELKGIDFKEDGNILGHKLEYNYNSHNVYIMADKQKNGIKSNFKIRHNIEDGSVQLADHYQQNTPIGDGPVLLPDNHYLSTQSKLSKDPNEKRDHMVLLEFVTAAGITLGMDELYK

SEQ ID NO: 427 - protein, 232 aa, Entacmaea quadricolor
MVSELIKENMPMKLYMEGTVNNHHFKCTSEGEGKPYEGTQTMRIKVVEGGPLPFAFDILATSFMYGSRTFIKHPPGIPDFFKQSFPEGFTWERVTTYEDGGVLTATQDTSLQDGCLIYNVKVRGVNFPANGPVMQKKTLGWEASTETMYPADGGLEGACDMALKLVGGGHLICNLETTYRSKKPATNLKMPGVYNVDHRLERIKEADDETYVEQHEVAVARYSTGGAGDGGK

SEQ ID NO: 428 - protein, 227 aa, Echinopora forskaliana
MSVIKQVMKTKLHLEGTVNGHDFTIEGKGEGKPYEGLQHMKMTVTKGAPLPFSVHILTPSHMYGSKPFNKYPADIPDYHKQSFPEGMSWERSMIFEDGGVCTASNHSSINLQENCFIYDVKFHGVNLPPDGPVMQKTIAGWEPSVETLYVRDGMLKSDTAMVFKLKGGGHHRVDFKTTYKAKKPVKLPEFHFVEHRLELTKHDKDFTTWDQQEAAEGHFSPLPKALP

SEQ ID NO: 429 - protein, 235 aa, Entacmaea quadricolor
MVSKGEELIKENMHMKLYMEGTVNNHHFKCTSEGEGKPYEGTQTMRIKVVEGGPLPFAFDILATSFMYGSKTFINHTQGIPDFFKQSFPEGFTWERSTTYEDGGVLTATQDTSLQDGCLIYNVKIRGVNFPSNGPVMQKKTLGWEASTEMLYPADGGLEGRDYMALKLVGGGHLICNAKTTYRSKKPAKNLKMPGVYYVDRRLERIKEADKETSVEQHEVAVARYCDLPSKLGHK

SEQ ID NO: 430 - protein, 234 aa, Entacmaea quadricolor
MVSKGEELIKENMRSKLYLEGSVNGHQFKCTHEGEGKPYEGKQTARIKVVEGGPLPFAFDILATMFMYGSKVFIKYPADLPDYFKQSFPEGFTWERVMVFEDGGVLTATQDTSLQDGELIYNVKLRGVNFPANGPVMQKKTLGWEPSTETMYPADGGLEGRCDKKLKLVGGGHLHVNFKTTYKSKKPVKMPGVHYVDRRLERIKEADNETYVEQYEHAVARYSNLGGGMDELYK

SEQ ID NO: 431 - protein, 237 aa, Anthoathecata
MEVGPALFQSDMTFKIFIDGEVNGQKFTIVADGSSKFPHGDFNVHAVCETGKLPMSWKPICHLIQWGEPFFARYPDGISHFAQECFPEGLSIDRTVRFENDGTMTSHHTYELDDTCVVSRITVNCDGFQPDGPIMRDQLVDILPSETHMFPHGPNAVRQTATIGFTTADGGKMMGHFDSKMTFNGSRAIEIPGPHFVTIITKQTRDTSDKRDHVCQREVAYAHSVPRITSAIGSDED

SEQ ID NO: 432 - protein, 231 aa, Entacmaea quadricolor
MNSLIKENMRMMVVMEGSVNGYQFKCTGEGDGNPYMGTQTMRIKVVEGGPLPFAFDILATSFMYGSKTFIKHTKGIPDFFKQSFPEGFTWERVTRYEDGGVFTVMQDTSLEDGCLVYHAKVTGVNFPSNGAVMQKKTKGWEPSTEMLYPADGGLRGYSQMALNVDGGGYLSCSFETTYRSKKTVENFKMPGFHFVDHRLERLEESDKEMFVVQHEHAVAKFCDLPSKLGRL

SEQ ID NO: 433 - protein, 239 aa, Aequorea victoria
MVSKGEELFTGVVPILVELDGDVNGHKFSVRGEGEGDATNGKLTLKFISTTGKLPVPWPTLVTTLSHGVQVFARYPDHMKQHDFFKSAMPEGYVQERTIFFKDDGTYKTRAEVKFEGDTLVNRIELKGVDFKEDGNILGHKLEYNFNSHNIYIMAVKQKNGIKANFKIRHNVEDGSVQLADHYQQNTPIGDGPVLLPDSHYLSTQSKLSKDPNEKRDHMVLLEFRTAAGITLGMDELYK

SEQ ID NO: 434 - protein, 239 aa, Aequorea victoria
MVSKGEELFTGVVPILVELDGDVNGHKFSVRGEGEGDATNGKLTLKFISTTGKLPVPWPTLVTTLSHGVQVFARYPDHMKQHDFFKSAMPEGYVQERTIFFKDDGTYKTRAEVKFEGDTLVNRIELKGVDFKEDGNILGHKLEYNFNSHNIYIMAVKQKNGIKANFKIRHNVEDGSVQLADHYQQNTPIGDGPVLLPDSHYLSTQSVLSKDPNEKRDHMVLLEFRTAAGITLGMDELYK

SEQ ID NO: 435 - protein, 237 aa, Anthoathecata
MECGPALFQSDMTFKIFIDGEVNGQKFTIVADGSSKFPHGDFNVHAVCETGKLPMSWKPICHLIQWGEPFFARYPDGISHFAQECFPEGLSIDRTVRFENDGTMTSHHTYELSDTCVVSRITVNCDGFQPDGPIMRDQLVDILPSETHMFPHGPNAVRQLAFIGFTTADGGLMMGHLDSKMTFNGSRAIEIPGPHFVTIITKQMRDTSDKRDHVCQREVAHAHSVPRITSAIGSDQD

SEQ ID NO: 436 - protein, 237 aa, Clavularia sp.
MVSKGEETIMSVIKPDMKIKLRMEGNVNGHAFVIEGEGSGKPFEGIQTIDLEVKEGAPLPFAYDILTTAFHYGNRVFTKYPEDIPDYFKQSFPEGYSWERSMTYEDGGICIATNDITMEEDSFINKIHFKGTNFPPNGPVMQKRTVGWEASTEKMYVRDGVLKGDVKMKLLLKGGGHYRCDFRTTYKVKQKAVKLPDYHFVDHRIEILSHDKDYNKVKLYEHAVAHSGLPGMDELYK

SEQ ID NO: 437 - protein, 266 aa, Clavularia sp.
MKCKFVFCLSFLVLAITNANIFLRNEADLEEKTLRIPKALTTMGVIKPDMKIKLKMEGNVNGHAFVIEGEGEGKPYDGTHTLNLEVKEGAPLPFSYDILSNAFQYGNRALTKYPDDIADYFKQSFPEGYSWERTMTFEDKGIVKVKSDISMEEDSFIYEIRFDGMNFPPNGPVMQKKTLKWEPSTEIMYVRDGVLVGDISHSLLLEGGGHYRCDFKSIYKAKKVVKLPDYHFVDHRIEILNHDKDYNKVTLYENAVARYSLLPSQA

SEQ ID NO: 438 - protein, 239 aa, Aequorea victoria
MVSKGEELFTGVVPILVELDGDVNGHKFSVSGEGEGDATYGKLTLKFICTTGKLPVPWPTLVTTLTYGVLCFSRYPDHMKQHDFFKSAMPEGYVQERTIFFKDDGNYKTRAEVKFEGDTLVNRIELKGIDFKEDGNILGHKLEYNYNSHNAYIMADKQKNGIKSNFKIRHNIEDGSVQLADHYQQNTPIGDGPVLLPDNHYLSTQNKLSKDPNEKRDHMVLLEFVTAAGITLGMDELYK

SEQ ID NO: 439 - protein, 223 aa, Verrillofungia concinna
MSVIKPEMKMRYRMDGSVNGHEFTVEGEGTGRPYEGKHKITLDVTKGGPLPFAFDLLSTVFSYGNRALTKYPDDIPDYFKQCFPGGYSWERKFEFEDGGLAIAKAEISLKGNCFEHKSTIEGTFPDSSPIMQNKTLGWEPSTEKMTVRDGSMKGDDAAYLKLVGGGNHKCYFTTTYTAKKKIPNLPKSHFIGHRISSVVEGTKIKVMEDAIAHLYPFNGSPCQ

SEQ ID NO: 440 - protein, 232 aa, Olindias formosus
MASGRALFQYPMTSKIELNGEINGKKFKVAGEGFTPNSGRFNMHAYCTTGDLPMSWVVIASPLQYGFHMFAHYPEDITHFFQECFPGSYTLDRTLRMEGDGTLTTHHEYSLKDGCVTSKTTLNASGFDPKGATMTKSFVEQLPNQVEITAEGNGIRLTSTVPYLKKDGTIQIGRQDCIVKPVGGKKVTQPKAHFLHTQIIQKKDPNDTRDHIVQTELAVAGNPWHEPSASAV

SEQ ID NO: 441 - protein, 237 aa, Clavularia sp.
MVSKGEETIMSVIKPDMKIKLRMEGNVNGHAFVIEGEGSGKPFEGIQTIDLEVKEGAPLPFAYDILTTAFHYGNRVFTKYPEDIPDYFKQSFPEGYSWERSMTYEDGGICIATNDITMEEDSFINKIHFKGTNFPPNGPVMQKRTVGWEVSTEKMYVRDGVLKGDVKMKLLLKGGSHYRCDFRTTYKVKQKAVKLPDYHFVDHRIEILSHDKDYNKVKLYEHAVARNSTDSMDELYK

SEQ ID NO: 442 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNYISDNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 443 - protein, 231 aa, Entacmaea quadricolor
MNSLIKENMRMMVVMEGSVNGYQFKCTGEGDGNPYMGTQTMRIKVVEGGPLPFAFDILATSFMYGSKTFIKHTKGIPDFFKQSFPEGFTWERVTRYEDGGVFTVMQDTSLEDGCLVYHAKVTGVNFPSNGAVMQKKTKGWEPSTEMLYPADGGLRGYAQMALNVDGGGYLFCSFETTYRSKKTDENFKMPGFHFVDHRLERLEESDKEMFVVQHEHAVAKFCDLPSKLGRL

SEQ ID NO: 444 - protein, 244 aa, Entacmaea quadricolor [sequence omitted]

SEQ ID NO: 445 - protein, 239 aa, Aequorea victoria
MVSKGEELFTGVVPILVEMDGDVNGRKFSVRGVGEGDATHGKLTLKFICTSGKLPVPWPTLVTTLSYGVQCFSRYPDHMKQHDFFKSAMPEGYVQERTIFFKDDGSYKTRAEVKFEGDTLVNRIVLKGTDFKEDGNILGHKLEYNMNVGNVYITADKQKNGIKANFEIRHNVEDGGVQLADHYQQNTPIGDGSVLLPDNHYLSVQVKLSKDPNEKRDHMVLLEFRTAAGITPGMDELYK

SEQ ID NO: 446 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAISDNVYITADKQKNGIKANFKIRHNIEDGSVQLADHYQQNTPIGDGPVLLPDNHYLSTQSKLSKDPNEKRDHMVLLEFVTAAGITLGMDELYK

SEQ ID NO: 447 - protein, 239 aa, Aequorea victoria
MVSKGEELFTGVVPILVELDGDVNGHKFSVSGEGEGDATYGKLTLKFICTTGKLPVPWPTLVTTLSHGVQCFARYPDHMKQHDFFKSAMPEGYVQERTIFFKDDGNYKTRAEVKFEGDTLVNRIELKGIDFKEDGNILGHKLEYNFNSHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 448 - protein, 224 aa, Verrillofungia concinna
DPTMVSVIKPEMKMRYYMDGSVNGHEFTVEGEGTGRPYEGKQKITLDVTKGGPLPFAFDLLSTVFSYGNRALTKYPDDIPDYFKQCFPGGYSWERKFEFEDGGLAIAKAEISLKGNCFEHKSTIEGTFPDSSPIMQNKTLGWEPSTEKMTVRDGSMKGDDASYLKLVGGGNHKCYFTTTYTAKKKIPNLPGSHFIGHRISSVVEGTKIKVMEDAIAHLYPFNGS

SEQ ID NO: 449 - protein, 237 aa, Zoanthus sp
MVSKGEGQSKHGLKEEMTVKYHMEGCVNGHKFVITGEGIGNPFKGKQTANLCVIEGGPLPFSEDILSPGFKYGDRIFTEYPQDIVDYFKNSCPAGYTWERSYLFEDGAVCRCNVDITVSEKENCIYHKSIFRGVNFPADGPVMKKMTTNWEASTEKIVPVPKQGILKGKVKMYLLLKDGGRYHCQFDTVYKAKSVPSKMPEWHFIQHKLLREDRSDAKNQKWQLTEHAIAGMDELYK

SEQ ID NO: 450 - protein, 234 aa, Entacmaea quadricolor
MGEDSELISENMHMKLYMEGTVNGHHFKCTSEGEGKPYEGTQTAKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEASTEMLYPADSGLRGHSQMALKLVGGGYLHCSLKTTYRSKKPAKNLKMPGFYFVDRKLERIKEADKETYVEQHEMAVARYCDLPSKLGHS

SEQ ID NO: 451 - protein, 236 aa, Clavularia sp.
MVSKGEETTMGVIKPDMKIKLKMEGNVNGHAFVIEGEGEGKPYDGTNTINLEVKEGAPLPFSYDILTTAFAYGNRAFTKYPDDIPNYFKQSFPEGYSWERTMTFEDKGIVKVKSDISMEEDSFIYEIHLKGENFPPNGPVMQKKTTGWDASTERMYVRDGVLKGDVKMKLLLEGGGHHRVDFKTIYRAKKAVKLPDYHFVDHRIEILNHDKDYNKVTVYESAVARNSTDGMDELYK

SEQ ID NO: 452 - protein, 239 aa, Aequorea victoria
MASKGEELFTGVVPILVELDGDVNGHKFSVSGEGEGDATYGKLTLKFICTTGKLPVPWPTLVTTLSYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 453 - protein, 232 aa, Acropora sp. #30
MVSYSKQGIAQEMRTKYRMEGSVNGHEFTIEGVGTGNPYEGKQTSELVIIKPKGKPLPFSFDILSTVFQYGNRCFTKYPADMPDYFKQAFPDGMSYERSFLFEDGGVATASWSIRLEGNCFIHNSIYHGTNFPADGPVMKKQTIGWDKSSEKMSVAKEVLRGDVTQFLLLEGGGYQRCQLHSTYKTEKPVAMPPSHVVEHQIVRTDLGQTAKGFKVKLEEHAEAHVNPLKVK

SEQ ID NO: 454 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNAISDNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 455 - protein, 232 aa, Artificial Sequence
  Synthetic Construct
MVSKGEAVIKEFMRFKVHMEGSMNGHEFEIEGEGEGRPYEGTQTAKLKVTKGGPLPFSWDILSPQFMYGSRAFTKHPADIPDYYKQSFPEGFKWERVMNFEDGGAVTVTQDTSLEDGTLIYKVKLRGTNFPPDGPVMQKKTMGWEASTERLYPEDGVLKGDIKHALRLKDGGRYLADFKTTYKAKKPVQMPGAYNVDRKLDITSHNEDYTVVEQYERSEGRHSTGGMDELYK

SEQ ID NO: 456 - protein, 225 aa, Dendronephthya sp.
MNLIKEDMRVKVHMEGNVNGHAFVIEGEGKGKPYEGTQTANLTVKEGAPLPFSYDILTTAVHYGNRVFTKYPEDIPDYFKQSFPEGYSWERTMTFEDKGICTIRSDISLEGDCFFQNVRFKGTNFPPNGPVMQKKTLKWEPSTEKLHVRDGLLVGNINMALLLEGGGHYLCDFKTTYKAKKVVQLPDAHFVDHRIEILGNDSDYNKVKLYEHAVARYSPLPSQAW

SEQ ID NO: 457 - protein, 231 aa, Entacmaea quadricolor; identical to SEQ ID NO: 94

SEQ ID NO: 458 - protein, 311 aa, Rhodopseudomonas palustris CGA009
MARKVDLTSCDREPIHIPGSIQPCGCLLACDAQAVRITRITENAGAFFGRETPRVGELLADYFGETEAHALRNALAQSSDPKRPALIFGWRDGLTGRTFDISLHRHDGTSIIEFEPAAAEQADNPLRLTRQIIARTKELKSLEEMAARVPRYLQAMLGYHRVMLYRFADDGSGMVIGEAKRSDLESFLGQHFPASLVPQQARLLYLKNAIRVVSDSRGISSRIVPEHDASGAALDLSFAHLRSISPCHLEFLRNMGVSASMSLSIIIDGTLWGLIICHHYEPRAVPMAQRVAAKRFAERLSTHFTAAHHQR

SEQ ID NO: 459 - protein, 316 aa, Rhodopseudomonas palustris CGA009
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGEVIAEDRCAEVESKLGLHYPASTVPAQARRLYTINPVRIIPDINYRPVPVTPDLNPVTGRPIDLSFAILRSVSPCHLEFMRNIGMHGTMSISILRGERLWGLIVCHHRTPYYVDLDGRQACELVAQVLAWQIGVMEE

SEQ ID NO: 460 - protein, 316 aa, Rhodopseudomonas palustris CGA009
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGEVIAEDRCAEVESKLGLHYPASTVPAQARRLYTINPVRIIPDINYRPVPVTPDLNPVTGRPIDLSFAILRSVSPCHLEFMRNIGMHGTMSISILRGERLWGLIVCHHRTPYYVDLDGRQACKRVAERLATQIGVMEE

SEQ ID NO: 461 - protein, 239 aa, Aequorea victoria
MVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSKLSKDPNEKRDHMVLLEFVTAAGITLGMDELYK

SEQ ID NO: 462 - protein, 237 aa, Anthomedusae sp. DC-2005
MEVGPALFQSDMTFKIFIDGEVNGQKFTIVADGSSKFPHGDFNVHAVCETGKLPMSWKPICHLIQYGEPFFARYPDGISHFAQECFPEGLSIDRTVRFENDGTMTSHHTYELDDTCVVSRITVNCDGFQPDGPIMRDQLVDILPSETHMFPHGPNAVRQTATIGFTTADGGKMMGHFDSKMTFNGSRAIEIPGPHFVTIITKQTRDTSDKRDHVCQREVAYAHSVPRITSAIGSDED

SEQ ID NO: 463 - protein, 244 aa, Entacmaea quadricolor
MVSKGEELIKENMHMKLYMEGTVNNHHFKCTSEGEGKPYEGTQTGRIKVVEGGPLPFAFDILATCFMYGSKTFINHTQGIPDFFKQSFPEGFTWERVTTYEDGGVLTATQDTSLQDGCLIYNVKIRGVNFPSNGPVMQKKTLGWEASTETLYPADGGLEGRCDMALKLVGGGHLICNLKTTYRSKKPAKNLKMPGVYFVDRRLERIKEADKETYVEQHEVAVARYCDLPSKLGHKLNGMDELYK

SEQ ID NO: 464 - protein, 238 aa, Aequorea victoria
MSKGEELFTGVVPILVELDGDVNGHKFSVSGEGEGDATYGKLTLKFICTTGKLPVPWPTLVTTLSHGVQCFSRYPDHMKQHDFFKSAMPEGYVQERTIFFKDDGNYKTRAEVKFEGDTLVNRIELKGIDFKEDGNILGHKLEYNANSHNIYIMADKQKNGIKANFKIRHNIEDGSVQLADHYQQNTPIGDGPVLLPDNHYLSTQSALSKDPNEKRDHMVLLEFRTAAGITHGMDELYK

SEQ ID NO: 465 - protein, 237 aa, Entacmaea quadricolor
MVSKGEELIKENMRMKVVMEGSVNGHQFKCTGEGEGRPYEGVQTMRIKVIEGGPLPFAFDILATSFMYGSRTFIKYPADIPDFFKQSFPEGFTWERVTRYEDGGVVTVTQDTSLEDGELVYNVKVRGVNFPSNGPVMQKKTKGWEADTEMMYPADGGLRGYLDRALKVDGGGHLHCNFVTTYRSKKTVGDIKMPGVHAVDHRLERIEESDNETYVVQREVAVAKYSNLGGGMDELYK

SEQ ID NO: 466 - protein, 244 aa, Entacmaea quadricolor
MVSKGEELIKENMHMKLYMEGTVNNHHFKCTSEGEGKPYEGTQTGRIKVVEGGPLPFAFDILATCFMYGSKTFINHTQGIPDFFKQSFPEGFTWERVTTYEDGGVLTATQDTSLQDGCLIYNVKIRGVNFPSNGPVMQKKTLGWEASTEMLYPADGGLEGRCDMALKLVGGGHLICNLKTTYRSKKPAKNLKMPGVYFVDRRLERIKEADKETYVEQHEVAVARYCDLPSKLGHKLNGMDELYK

SEQ ID NO: 467 - protein, 239 aa, Aequorea victoria
MVSKGEELFTGVVPILVELDGDVNGHKFSVRGEGEGDATNGKLTLKFICTTGKLPVPWPTLVTTLAYGVLCFSRYPDHMKRHDFFKSAMPEGYVQERTISFKDDGTYKTRAEVKFEGDTLVNRIELKGIDFKEDGNILGHKLEYNFNSHNVYITADKQKNGIKSNFKIRHNVEDGSVQLADHYQQNTPIGDGPVLLPDNHYLSTQSKLSKDPNEKRDHMVLLEFVTAAGITHGMDELYK

SEQ ID NO: 468 - protein, 236 aa, Discosoma sp.
MVSKGEEDNMAIIKEFMRFKVHLEGSVNGHEFEIEGEGEGRPYEGTQTAKLKVTKGGPLPFAWDILSPQFMYGSNAYVKHPADIPDYFKLSFPEGFKWERVMNFEDGGVVTVTQDSSLQDGEFIYKVKLRGTNFPSDGPVMQKKTMGWETLSERMYPEDGALKGELKARTKLKDGGHYDTEVKTTYKAKKPVQLPGAYNVNRKLDITSHNEDYTIVEQYERAEGLHSTGGMDELYK

SEQ ID NO: 469 - protein, 237 aa, Clavularia sp.
MVSKGEETIMSVIKPDMKIKLRMEGNVNGHAFVIEGEGSGKPFEGIQTIDLEVKEGAPLPFAYDILTTAFHYGNRVFTKYPRKIPDYFKQSFPEGYSWERSMTYEDGGIVQATNDITMEEDSFINKIHFKGTNFPPNGPVMQKRTVGWEVSTEKMYVRDGVLKGDVKMKLLLKGGSHYRADFRTTYKVKQKAVKLPKAHFVDHRIEILSHDKDYNKVKLYEHAVARDSTDSMDELYK

SEQ ID NO: 470 - protein, 311 aa, Rhodopseudomonas palustris CGA009
MARKVDLTSCDREPIHIPGSIQPCGCLLACDAQAVRITRITENAGAFFGRETPRVGELLADYFGETEAHALRNALAQSSDPKRPALIFGWRDGLTGRTFDISLHRHDGTSIIEFEPAAAEQADNPLRLTRQIIARTKELKSLEEMAARVPRYLQAMLGYHRVMLYRFADDGSGMVIGEAKRSDLESFLGQHFPASLVPQQARLLYLKNAIRVVSDSRGISSRIVPEHDASGAALDLSFAHLRSISPCHLEFLRNMGVSASMSLSIIIDGTLWGLIICHHYEPRAVPMAQRVAAEMFADFLSLHFTAAHHQR

SEQ ID NO: 471 - protein, 237 aa, Clavularia sp.
MVSKGEETIMSVIKPDMKIKLRMEGNVNGHAFVIEGEGSGKPFEGIQTIDLEVKEGAPLPFAYDILTTAFHYGNRVFTKYPRKIPDYFKQSFPEGYSWERSMTYEDGGICNATNDITMEEDSFINKIHFKGTNFPPNGPVMQKRTVGWEVSTEKMYVRDGVLKGDVKMKLLLKGGSHYRCDFRTTYKVKQKAVKLPKAHFVDHRIEILSHDKDYNKVKLYEHAVARNSTDSMDELYK

SEQ ID NO: 472 - protein, 231 aa, Entacmaea quadricolor
MNSLIKENMRMMVVMEGSVNGYQFKCTGEGDGNPYMGTQTMRIKVVEGGPLPFAFDILATSFMYGSKTFIKHTKGIPDFFKQSFPEGFTWERVTRYEDGGVFTVMQDTSLEDGCLVYHAKVTGVNFPSNGAVMQKKTKGWEPSTEMLYPADGGLRGYCQMALNVDGGGYLFCSFETTYRSKKTDENFKMPGFHFVDHRLERLEESDKEMFVVQHEHAVAKFCDLPSKLGRL

SEQ ID NO: 473 - protein, 310 aa, Rhodopseudomonas palustris
MAEGSVARQPDLLTCEHEEIHLAGSIQPHGALLVVSEHDHRVIQASANAAEFLNLGSVLGVPLAEIDGDLLIKILPHLDPTAEGMPVAVRCRIGNPSTEYCGLMHRPPEGGLIIELERAGPSIDLSGTLAPALERIRTAGSLRALCDDTVLLFQQCTGYDRVMVYRFDEQGHGLVFSECHVPGLESYFGNRYPSSTVPQMARQLYVRQRVRVLVDVTYQPVPLEPRLSPLTGRDLDMSGCFLRSMSPCHLQFLKDMGVRATLAVSLVVGGKLWGLVVCHHYLPRFIRFELRAICKRLAERIATRITALES

SEQ ID NO: 474 - protein, 315 aa, Rhodopseudomonas palustris
MVAGHASGSPAFGTASHSNCEHEEIHLAGSIQPHGALLVVSEHDHRVIQASANAAEFLNLGSVLGVPLAEIDGDLLIKILPHLDPTAEGMPVAVRCRIGNPSTEYCGLMHRPPEGGLIIELERAGPSIDLSGTLAPALERIRTAGSLRALCDDTVLLFQQCTGYDRVMVYRFDEQGHGLVFSECHVPGLESYFGNRYPSSTVPQMARQLYVRQRVRVLVDVTYQPVPLEPRLSPLTGRDLDMSGCFLRSMSPCHLQFLKDMGVRATLAVSLVVGGKLWGLVVCHHYLPRFIRFELRAICKRLAERIATRITALES

SEQ ID NO: 475 - protein, 232 aa, Aequorea victoria
MDSGALLFKQKIPLVVEFEGDVEGMKFSVRGKGHGDATNGRIEASFICTTGELPVPWSSIISSLTYGFLCFTKYPDGIKDFPKSAMPEGYVQERTISFENDGTYKTRAEVTFENGSVYNRVKLNGEGFNKGGNILGKKLEYSFNPHCIYVLGDKENNGIRCCFNVVHNIVGGGQLIASHSQLNTPLGGGPIAIPEYHHICNHTTLSKDPREPRDHMTVAEVLKAVDCKTAYL

SEQ ID NO: 476 - protein, 238 aa, Aequorea victoria
MSKGEELFTGVVPILVELDGDVNGHKFSVSGEGEGDATYGKLTLKFICTTGKLPVPWPTLVTTFSWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPKEKRDHMVLLEFVTAAGITHGMDELYK

SEQ ID NO: 477 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLFIQSALSKDPNEKRDHMVLLEFVTAAGITHGMDELYK

SEQ ID NO: 478 - protein, 239 aa, Aequorea victoria
MVSKGEELFTGVVPILVELDGDVNGHKFSVSGEGEGDATYGKLTLKFICTTGKLPVPWPTLVTTLTWGVQCFARYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 479 - protein, 225 aa, Discosoma sp.
MASSEDVIKEFMRFKVRMEGSVNGHEFEIEGEGEGRPYEGTQTAKLKVTKGGPLPFAWDILSPQFCYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKMRLKLKDGGHYDAEVKTTYMAKKPVQLPGAYKTDIKLDITSHNEDYTIVELYERAEGRHSTGA

SEQ ID NO: 480 - protein, 237 aa, Anthoathecata
MEGGPALFQSDMTFKIFIDGEVNGQKFTIVADGSSKFPHGDFNVHAVCETGKLPMSWKPICHLIQYGEPFFARYPDGISHFAQECFPEGLSIDRTVRFENDGTMTSHHTYELDDTCVVSRITVNCDGFQPDGPIMRDQLVDILPNETHMFPHGPNAVRQLAFIGFTTADGGLMMGHFDSKMTFNGSRAIEIPGPHFVTIITKQMRDTSDKRDHVCQREVAYAHSVPRITSAIGSDED

SEQ ID NO: 481 - protein, 232 aa, Discosoma striata
MSCSKSVIKEEMLIDLHLEGTFNGHYFEIKGKGKGQPNEGTNTVTLEVTKGGPLPFGWHILCPQFQYGNKAFVHHPDNIHDYLKLSFPEGYTWERSMHFEDGGLCCITNDISLTGNCFYYDIKFTGLNFPPNGPVVQKKTTGWEPSTERLYPRDGVLIGDIHHALTVEGGGHYACDIKTVYRAKKAALKMPGYHYVDTKLVIWNNDKEFMKVEEHEIAVARHHPFYEPKKDK

SEQ ID NO: 482 - protein, 239 aa, Aequorea victoria
MASKGEELFTGVVPILVELDGDVNGHKFSVSGEGEGDATYGKLTLKFICTTGKLPVPWPTLVTTLSYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKTRHNIEDGSVQLADHYQQNTPIGDGPVLLPDNHYLSTQSALSKDPNEKRDHMVLLEFVTAAGITHGMDELYN

SEQ ID NO: 483 - protein, 147 aa, Nostoc punctiforme
MANLDKMLNTTVTEVRQFLQVDRVCVFQFEEDYSGVVVVEAVDDRWISILKTQVRDRYFMETRGEEYSHGRYQAIADIYTANLTECYRDLLTQFQVRAILAVPILQGKKLWGLLVAHQLAAPRQWQTWEIDFLKQQAVVVGIAIQQS

SEQ ID NO: 484 - protein, 316 aa, Rhodopseudomonas palustris CGA009
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGVVIAEDRCAEVESKLGLHYPASAVPAQARRLYTINPVRIIPDINYRPVPVTPDLNPVTGRPIDLSFAILRSVSPCHLEFMRNIGMHGTMSISILRGERLWGLIVCHHRTPYYVDLDGRQACKRVAERLATQIGVMEE

SEQ ID NO: 485 - protein, 236 aa, Artificial Sequence
  Synthetic Construct
MVSKGEEDNMTIIKEFMRFKVHMEGSVNGHEFEIEGEGEGRPYEGTQTAKLKVTKGGPLPFAWDILSPQFMYGSKAYVKHPADIPDYLKLSFPEGFNWERVMNFEDGGVVTVTQDSSLQDGEFIYKVKLRGTNFPSDGPVMQCRTMGLEASTERMYPEDGALKGESKERLKLKDGGHYDAEVKTTYKAKKPVQLPGAYNVDIKLDILSHNEDYTIVEQYERSEGRHSTGGMDELYK

SEQ ID NO: 486 - protein, 239 aa, Aequorea victoria
MVSKGEELFTGVVPILVELDGDVNGHKFSVRGEGEGDATNGKLTLKFICTTGKLPVPWPTLVTTLAYGVLCFSRYPDHMKRHDFFKSAMPEGYVQERTISFKDDGTYKTRAEVKFEGDTLVNRIELKGIDFKEDGNILGHKLEYNYNSHNVYITADKQKNGIKSNFKIRHNVEDGSVQLADHYQQNTPIGDGPVLLPDNHYLSTQSKLSKDPNEKRDHMVLLEFVTAAGITHGMDELYK

SEQ ID NO: 487 - protein, 316 aa, Rhodopseudomonas palustris
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGVVIAEDRCAEVESKLGLHYPASAVPAQARRLYTINPVRIIPDINYRPVPVTPDLNPVTGRPIDLSFAILRSVSPCHLEFMRNIGMHGTMSISILRGERLWGLIVCHHRTPYYVDLDGRQACELVAQVLAWQIGVMEE

SEQ ID NO: 488 - protein, 132 aa, Trichodesmium erythraeum IMS101
MKTGEQRVKIATLLSENEKKIVDKASQDLWRRRPDFIAPGGIAFGQRERALCLRDYGWYLRLITFCLLAGDKDPIESIGLIGIREMYNSLGVPVPGMMESIRCLKEASLSLLDEEDAKETAPYFDYIIQAMS

SEQ ID NO: 489 - protein, 229 aa, Anemonia majano
MALSNKFIGDDMKMTYHMDGCVNGHYFTVKGEGNGKPYEGTQTSTFKVTMANGGPLAFSFDILSTVFKYGNRCFTAYPTSMPDYFKQAFPDGMSYERTFTYEDGGVATASWEISLKGNCFEHKSTFHGVNFPADGPVMAKKTTGWDPSFEKMTVCDGILKGDVTAFLMLQGGGNYRCQFHTSYKTKKPVTMPPNHVVEHRIARTDLDKGGNSVQLTEHAVAHITSVVPF

SEQ ID NO: 490 - protein, 227 aa, Entacmaea quadricolor
MNSLIKENMRMKVVLEGSVNGHQFKCTGEGEGNPYMGTQTMRIKVIEGGPLPFAFDILATSFMYGSKTFIKYPKGIPDFFKQSFPEGFTWERVTRYEDGGVITVMQDTSLEDGCLVYHAQLRGVNFPSNGAVMQKKTKGWEPNTEMMYPADGGLRGYNHMALKVDGGGHLHCSLVTTYRSKKTVGNIKMPGIHAVDRRLERLEESDNEMFVVQREHAVAKFAGLGGG

SEQ ID NO: 491 - protein, 313 aa, Rhodopseudomonas palustris
MVAGHASGSPDFGTADPSDCEREEIHLAGSIQPHGTLLVVSEPDHRIIQASANAAEFLNLGSVLGVPLAEIDGDLLIKILPHLDPTAEGMPVAVRCRIGNPSTEYDGLMHRPPEGGLIIELERAGPPIDLSGTLAPALERIRTAGSLRALCDDTALLFQQCTGYDRVMVYRFDEQGHGEVYSEIHVTGLESYFGNRYPSSLVPQMARRLYERQRVRVLVDVSYQPVPLEPRLSPLTGRDLDMSGCFLRSMSPTHLQFLKNMGVRATLVVSLVVGGKLWGLVICHHYLPRFIHFELRAICELLAEAIATRITAL

SEQ ID NO: 492 - protein, 244 aa, Entacmaea quadricolor
MVSKGEELIKENMHTKLYLTGTVNNHYFECTAEGEGKPYEGTQTNRIKVVRGGPLPFAFDILAPCFMYGSKTFINHPPDIPDYFKQSFPEGFTWERTTVYEDGGTLTATQDTSLQDGCLIYNVQVRGENFPSNGPVMQKKTLGWEASTETLYPADGSLEGRLDWALKLVGGGHLHCRLETTYRSKKPAKNLKMPGVYFIDRRLERIKEADNETYVEQHEVAVARYCDLPSKLGHKLNGMDELYK

SEQ ID NO: 493 - protein, 316 aa, Rhodopseudomonas palustris
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRHTNSAIRRLQAAETLESACAAAAQEVRKITGFDRVMIYRFASDFSGEVIAEDRCAEVESKLGLHYPASTVPAQARRLYTINPVRIIPDINYRPVPVTPDLNPVTGRPIDLSFAILRSVSPVHLEFMRNIGMHGTMSISILRGERLWGLIVCHHRTPYYVDLDGRQACELVAQVLARAIGVMEE

SEQ ID NO: 494 - protein, 227 aa, Entacmaea quadricolor
MNSLIKENMRMKVVLEGSVNGHQFKCTGEGEGNPYMGTQTMRIKVIEGGPLPFAFDILATSFMYGSKTFIKYPKGIPDFFKQSFPEGFTWERVTRYEDGGVITVMQDTSLEDGCLVYHAQVRGVNFPSNGAVMQKKTKGWEPNTEMMYPADGGLRGYNHMALKVDGGGHLSCSLVTTYRSKKTVGNIKMPGIHAVDRRLERLEESDNEMFVVQREHAVAKFAGLGGG

SEQ ID NO: 495 - protein, 231 aa, Zoanthus sp.
MAHSKHGLKEEMTMKYHMEGCVNGHKFVITGEGIGYPFKGKQTINLCVIEGGPLPFSEDILSAGFKYGDRIFTEYPQDIVDYFKNSCPAGYTWGRSFLFEDGAVCICNVDITVSVKENCIYHKSIFNGMNFPADGPVMKKMTTNWEASCEKIMPVPKQGILKGDVSMYLLLKDGGRYRCQFDTVYKAKSVPSKMPEWHFIQHKLLREDRSDAKNQKWQLTEHAIAFPSALA

SEQ ID NO: 496 - protein, 236 aa, Discosoma sp.; identical to SEQ ID NO: 103

SEQ ID NO: 497 - protein, 315 aa, Rhodopseudomonas palustris
MVAGHASGSPAFGTASHSNSEHEEIHLAGSIQPHGALLVVSEHDHRVIQASANAAEFLNLGSVLGVPLAEIDGDLLIKILPHLDPTAEGMPVAVRCRIGNPSTEYCGLMHRPPEGGLIIELERAGPSIDLSGTLAPALERIRTAGSLRALCDDTVLLFQQCTGYDRVMVYRFDEQGHGLVFSECHVPGLESYFGNRYPSSTVPQMARQLYVRQRVRVLVDVTYQPVPLEPRLSPLTGRDLDMSGCFLRSMSPCHLQFLKDMGVRATLAVSLVVGGKLWGLVVCHHYLPRFIRFELRAICKRLAERIATRITALES

SEQ ID NO: 498 - protein, 238 aa, Aequorea victoria
MSKGEELFTGVVPILVELDGDVNGHKFSVSGEGEGDATYGKLTLKFICTTGKLPVPWPTLVTTFAWGVQCFARYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 499 - protein, 234 aa, Discosoma sp.
MVSKGEEVIKEFMRFKVRMEGSMNGHEFEIEGEGEGRPYEGTQTAKLKVTKGGPLPFAWDILSPLLMYGSKMYVKHPADIPDYKKLSFPEGFKWVRVMNFEDGGLVTATQDSSLQDGTLIYEVKMRGTNFPPDGPVMQKKTMGWEASTERLYPRDGVLKGEIHQALKLKDGGHYLVEFKTIYMAKKPVQLPGYYYVDTKLDITSHNEDYTRVEQYERSEGRHHLFLYDMDELYK

SEQ ID NO: 500 - protein, 232 aa, Entacmaea quadricolor
MVSELIKENMPMKLYMEGTVNNHHFKCTSEGEGKPYEGTQTMRIKVVEGGPLPFAFDILATSFMYGSRTFIKHPPGIPDFFKQSFPEGFTWERVTTYEDGGVLTATQDTSLQDGCLIYNVKVRGVNFPANGPVMQKKTLGWEATTETMYPADGGLEGACDMALKLVGGGHLICNLETTYRSKKPATNLKMPGVYNVDHRLERIKEADDETYVEQHEVAVARYSTGGAGDGGK

SEQ ID NO: 501 - protein, 238 aa, Aequorea victoria
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIAADKQKNGIKVNFKIRHNIEDGSVQLADHYQQNTPIGDGPVLLPDNHYLSTQSALSKDPNEKRDHMVLLEFVTAAGITHGMDELYE

SEQ ID NO: 502 - protein, 310 aa, Rhodopseudomonas palustris
MAEGSVARQPDLLTCEHEEIHLAGSIQPHGALLVVSEHDHRVIQASANAAEFLNLGSVLGVPLAEIDGDLLIKILPHLDPTAEGMPVAVRCRIGNPSTEYCGLMHRPPEGGLIIELERAGPSIDLSGTLAPALERIRTAGSLRALCDDTVLLFQQCTGYDRVMVYRFDEQGHGLVFSECHVPGLESYFGNRYPSSLVPQMARQLYVRQRVRVLVDVTYQPVPLEPRLSPLTGRDLDMSGCFLRSMSPIHLQFLKDMGVRATLAVSLVVGGKLWGLVVCHHYLPRFIRFELRAICKRLAERIATRITALES

SEQ ID NO: 503 - protein, 315 aa, Rhodopseudomonas palustris
MVAGHASGSPAFGTASHSNCEHEEIHLAGSIQPHGALLVVSEHDHRVIQASANAAEFLNLGSVLGVPLAEIDGDLLIKILPHLDPTAEGMPVAVRCRIGNPSTEYCGLMHRPPEGGLIIELERAGPSIDLSGTLAPALERIRTAGSLRALCDDTVLLFQQCTGYDRVMVYRFDEQGHGLVFSECHVPGLESYFGNRYPSSLVPQMARQLYVRQRVRVLVDVTYQPVPLEPRLSPLTGRDLDMSGCFLRSMSPIHLQFLKDMGVRATLAVSLVVGGKLWGLVVCHHYLPRFIRFELRAICKRLAERIATRITALES

SEQ ID NO: 504 - protein, 219 aa, Entacmaea quadricolor
MELIKENMRMKLYMEGTVGNHHFKCTAEGEGKPYEGTQTQRIKVVEGGPLPFAFDILATCFMYGSKTFINYPQGIPDFFKQSFPEGFTWERVTTYEDGGVLTVTQDTSLQDGYLIYNVKLRGVNFPSNGPVMQKKTLGWEPTTEYLVPVDGGLEGTCDMALRLVGGGHLKCNLKTTYRSKKPAKNLKMPGEHQVDRKLERIKEADNETYVEQHEVAVAR

SEQ ID NO: 505 - protein, 232 aa, Entacmaea quadricolor
MVSELIKENMHMKLYMEGTVNNHHFKCTSEGEGKPYEGTQTMRIKAVEGGPLPFAFDILATSFMYGSKTFINHTQGIPDFFKQSFPEGFTWERVTTYEDGGVLTATQDTSLQDGCLIYNVKIRGVNFPSNGPVMQKKTLGWEACTETLYPADGGLEGRADMALKLVGGGHLICNLKTTYRSKKPAKNLKMPGVYYVDRRLERIKEADKETYVEQHEVAVARYCDLPSKLGHR

SEQ ID NO: 506 - protein, 222 aa, Montipora sp. 20
MVSVIAKQMTYKVYMSGTVNGHYFEVEGDGKGKPYEGEQTVKLTVTKGGPLPFAWDILSPLFQYGSIPFTKYPEDIPDYVKQSFPEGYTWERTMNFEDGAVCTVSNDSSIQGNCFIYNVKISGTNFPPNGPVMQKKTQGWEPSTERLFARDGMLIGNDYMALKLEGGGHYLCEFKSTYKAKKPVRMPGYHYIDRKLDVTSHNRDYTSVEQCEIAIARHSLLG

SEQ ID NO: 507 - protein, 311 aa, Rhodopseudomonas palustris CGA009
MARKVDLTSCDREPIHIPGSIQPCGCLLACDAQAVRITRITENAGAFFGRETPRVGELLADYFGETEAHALRNALAQSSDPKRPALIFGWRDGLTGRTFDISLHRHDGTSIVEFEPAAAEQADNPLRLTRQIIARTKELKSLEEMAARVPRYLQAMLGYHRVMLYRFADDGSGKVIGEAKRSDLESFLGQHFPASLVPQQARLLYLKNAIRVVSDSRGISSRIVPEHDASGAALDLSFAHLRSISPIHLEFLRNMGVSASMSLSIIIDGTLWGLIICHHYEPRAVPMAQRVAAEMFADFLSLHFTAAHHQR

SEQ ID NO: 508 - protein, 238 aa, Aequorea victoria
MSKGEELFTGVVPILVELDGDVNGHKFSVSGEGEGDATYGKLTLKFISTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSCNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 509 - protein, 311 aa, Rhodopseudomonas palustris CGA009
MARKVDLTSCDREPIHIPGSIQPCGCLLACDAQAVRITRITENAGAFFGRETPRVGELLADYFGETEAHALRNALAQSSDPKRPALIFGWRDGLTGRTFDISLHRHDGTSIVEFEPAAAEQADNPLRLTRQIIARTKELKSLEEMAARVPRYLQAMLGYHRVMLYRFADDGSGKVIGEAKRSDLESFLGQHFPASLVPQQARLLYLKNAIRVVSDSRGISSRIVPEHDASGAALDLSFAHLRSISPIHLEFLRNMGVSASMSLSIIIDGTLWGLIICHHYEPRAVPMAQRVAAKRFAERLSTHFTAAHHQR

SEQ ID NO: 510 - protein, 219 aa, Branchiostoma lanceolatum
MPLPATHDLHISGSINGHEFDLEGSGKGNAKEGYQELHLKSNKGDLSFSPWILVPNIGYGFYQYLPFPDGAMSPYQAAMHDGGYVMHRSMQFEDGAMLHSDHRYIYKGNHIKGEFRLTGSGFPADGPVMTNSLTAADWCVDKLLYPNDNTIIGKFDWTYTTTSGKRYQSDVQTNVTFGKPIAADILKKQPMFVFRKVELKHTKTELNFKQWQKAFQDIA

SEQ ID NO: 511 - protein, 228 aa, Branchiostoma lanceolatum [sequence omitted]

SEQ ID NO: 512 - protein, 238 aa, Aequorea victoria
MSKGEELFTGVVPILVELDGDVNGHKFSVSGEGEGDATYGKLTLKFICTTGKLPVPWPTLVTTFSWGVQCFSRYPDHMKQHDFFKSAMPEGYVQERTIFFKDDGNYKTRAEVKFEGDTLVNRVELKGIDFKEDGNILGHKLEYNHNSRNVYITADKQKNGIKANFKIRHNIEDGSVQLADHYQQNTPIGDGPVLLPDNHYLSTQSALSKDPKEKRDHMVLLEFVTAAGITHGMDELYK

SEQ ID NO: 513 - protein, 219 aa, Entacmaea quadricolor
MELIKENMRMKLYMEGTVGNHHFKCTAEGEGKPYEGTQTQRIKVVEGGPLPFAFDILATCFMYGSKTFINHPQGIPDFFKQSFPEGFTWERVTTYEDGGVLTVTQDTSLQDGYLIYNVKLRGVNFPSNGPVMQKKTLGWEPTTETLVPVDGGLVGRCDMALRLVGGGHLKCNLKTTYRSKKPAKNLKMPGKYQVDRKLERIKEADNETYVEQHEVAVAR

SEQ ID NO: 514 - protein, 316 aa, Rhodopseudomonas palustris CGA009
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGEVIAEDRCAEVESKLGLHYPASTVPAQARRLYTINPVRIIPDINYRPVPVTPDLNPVTGRPIDLSFAILRSVSPVHLEFMRNIGMHGTMSISILRGERLWGLIVCHHRTPYYVDLDGRQACKRVAERLATQIGVMEE

SEQ ID NO: 515 - protein, 321 aa, Rhodopseudomonas palustris
MARDPQPFFPPLYLGGPEITTENCEREPIHIPGSIQPHGALLTADGHSGEVLQVSLNAATFLGQEPTVLRGQTLAALLPDQWPALQTALPPGCQDALQYRATLDWPAAGHLSLTVHRVAELLILEFEPTEAWDSIGPHALRNAMFALESAPNLRALAEVATQTVRELSGFDRVMLYKFAPDATGEVIAEARREGMQAYLGHRFPASTTPAQARALYTRHLLRLTADTRAAAVPLDPVLNPQTNAPTPLGGAVLRATSPMHMQYLRNMGVGSSLSVSVVVGGQLWGLIVCHHQTPYVLPPDLRTTLEYLGRLLSLQVQRKEA

SEQ ID NO: 516 - protein, 236 aa, Discosoma sp.
MVSKGEENNMAIIKEFMRFKVHMEGSVNGHEFEIEGEGEGRPYEAFQTAKLKVTKGGPLPFAWDILSPQFMYGSKVYIKHPADIPDYFKLSFPEGFRWERVMNFEDGGIIHVNQDSSLQDGVFIYKVKLRGTNFPSDGPVMQKKTMGWEASEERMYPEDGALYSEIKKRLKLKDGGHYAAEVKTTYKAKKPVQLPGAYIVDIKLDIVSHNEDYTIVEQYERAEGRHSTGGMDELYK

SEQ ID NO: 517 - protein, 320 aa, Bradyrhizobium sp.
MSVPLTTSAFGHAFLANCEREQIHLAGSIQPHGILLAVKEPDNVVIQASINAAEFLNTNSVVGRPLRDLGGDLPLQILPHLNGPLHLAPMTLRCTVGSPPRRVDCTIHRPSNGGLIVELEPATKTTNIAPALDGAFHRITSSSSLMGLCDETATIIREITGYDRVMVVRFDEEGNGEILSERRRADLEAFLGNRYPASTIPQIARRLYEHNRVRLLVDVNYTPVPLQPRISPLNGRDLDMSLSCLRSMSPIHQKYMQDMGVGATLVCSLMVSGRLWGLIACHHYEPRFVPFHIRAAGEALAETCAIRIATLESFAQSQSK

SEQ ID NO: 518 - protein, 321 aa, Deinococcus radiodurans
MARDPLPFFPPLYLGGPEITTENCEREPIHIPGSIQPHGALLTADGHSGEVLQVSLNAATFLGQEPTVLRGQTLAALLPEQWPALQAALPPGCPDALQYRATLDWPAAGHLSLTVHRVAELLILEFEPTEAWDSIGPHALRNAMFALESAPNLRALAEVATQTVRELTGFDRVMLYKFAPDATGEMIAEARREGMQAFLGHRFPASHTPAQARALYTRHLLRLTADTRAAAVPLDPVLNPQTNAPTPLGGAVLRATSPMHMQYLRNMGVGSSLSVSVVVGGQLWGLIVCHHQTPYVLPPDLRTTLEELGRKLSGQVQRKEA

SEQ ID NO: 519 - protein, 237 aa, Anthoathecata
MEVGPALFQSDMTFKIFIDGEVNGQKFTIVADGSSKFPHGDFNAHAVCETGKLPMSWKPICHLIQWGEPFFARYPDGISHFAQECFPEGLSIDRTVRFENDGTMTSHHTYELDDTCVVSRITVNCDGFQPDGPIMRDQLVDILPSETHMFPHGPNAVRQTATIGFTTADGGKMMGHFDSKMTFNGSRAIEIPGPHFVTIITKQTRDTSDKRDHVCQREVAYAHSVPRITSAIGSDED

SEQ ID NO: 520 - protein, 231 aa, Heteractis crispa
RSPGMSGLLKESMRIKMYMEGTVNGHYFKCEGEGDGNPFAGTQGMRIHVTEGAPLPFAFDILAPCCAYGSRTFVHHTAEIPDFFKQSFPEGFTWERTTTYEDGGILTAHQDTSLEGNCLIYKVKVHGTNFPADGPVMKNESGGWEPSTEVVYPENGVLCGRNVMALKVGDRHLICHLYTSYKSKKAVRALTMPGFHFTDIRLQMLRKKKDEYFELYEASVARYSDLPEKAN

SEQ ID NO: 521 - protein, 316 aa, Rhodopseudomonas palustris
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGEVIAEDRCAEVESKLGLHYPASTVPAQARRLYTINPVRIIPDINYRPVPVTPDLNPVTGRPIDLSFAILRSVSPVHLEFMRNIGMHGTMSISILRGERLWGLIVCHHRTPYYVDLDGRQACELVAQVLAWQIGVMEE

SEQ ID NO: 522 - protein, 106 aa, Arabidopsis thaliana
MEKSFVITDPRLPDNPIIFASDGFLELTEYSREEILGRNGRFLQGPETDQATVQKIRDAIRDQREITVQLINYTKSGKKFLNLLNLQPIRDQKGELQAFIGVVLDG

SEQ ID NO: 523 - protein, 316 aa, Rhodopseudomonas palustris
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRHTNSAIRRLQAAETLESACAAAAQEVRKITGFDRVMIYRFASDFSGEVIAEDRCAEVESKLGQHYPASDIPAQARRLYTINPVRIIPDINYRPVPVTPDLNPVTGRPIDLSFAILRSVSPVHLEFMRNIGMHGTMSISILRGERLWGLIVCHHRTPYYVDLDGRQACELVAQVLARAIGVMEE

SEQ ID NO: 524 - protein, 106 aa, Arabidopsis thaliana
MEKSFVITDPRLPDNPIIFASDGFLELTEYSREEILGRNGRFLQGPETDQATVQKIRDAIRDQREITVQLINYTKSGKKFLNLLHLQPMRDQKGELQYFIGVVLDG

SEQ ID NO: 525 - protein, 106 aa, Arabidopsis thaliana
MEKSFVITDPRLPDNPIIFASDGFLELTEYSREEILGRNGRFLQGPETDQATVQKIRDAIRDQREITVQLINYTKSGKKFWNLLHLQPMRDQKGELQYFIGVQLDG

SEQ ID NO: 526 - protein, 227 aa, Heteractis crispa
MAGLLKESMRIKMYMEGTVNGHYFKCEGEGDGNPFAGTQSMRIHVTEGAPLPFAFDILAPCCEYGSKTFVHHTAEIPDFFKQSFPEGFTWERTTTYEDGGILTAHQDTSLEGNCLIYKVKVHGTNFPADGPVMKNKSGGWEPSTEVVYPENGVLCGRNVMALKVGDRHLICHHYTSYRSKKAVRALTMPGFHFTDYRLQMLRKKKDEYFELYEASVARYSDLPEKAN

SEQ ID NO: 527 - protein, 316 aa, Rhodopseudomonas palustris
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGEVIAEDRCAEVESKLGLHYPASFIPAQARRLYTINPVRIIPDINYRPVPVTPDLNPVTGRPIDLSFAILRSVSPVHLEFMRNIGMHGTMSISILRGERLWGLIVCHHRTPYYVDLDGRQACKRVAERLATQIGVMEE

SEQ ID NO: 528 - protein, 236 aa, Discosoma sp.
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEGKGRLKLKDGGHYDAEVKTTYKAKKPVQLPGAYNVNIKLDITSHNEDYTIVEQYERAEGRHSTGGMDELYK

SEQ ID NO: 529 - protein, 238 aa, Aequorea victoria
ASKGEELFTGVVPILVELDGDVNGHKFSVSGEGEGDATYGKLTLKFICTTGKLPVPWPTLVTTLSHGVQCFSRYPDHMKRHDFFKSAMPEGYVQERTIFFKDDGNYKTRAEVKFEGDTLVNRIELKGIDFKEDGNILGHKLEYNFNSHNVYIMADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 530 - protein, 240 aa, Clavularia sp.
MVSKGEETTMGVIKPDMKIKLKMEGNVNGHAFVIEGEGEGKPYDGTNTVNLEVKEGAPLPFSYDILSNAFQYGNRAFTKYPDDIANYFKQSFPEGYSWERTMTFEDKGIVKVKSDISMEEDSFIYEIRLKGKNFPPNGPVMQKKTLKWEPSTEILYVRDGVLVGDIKHKLLLEGGGHYRCDFKTIYKAKKVVKLPDYHFVDHRIEILNHDKDYNKVTLYENAVARYSLLPPQAGMDELYK

SEQ ID NO: 531 - protein, 244 aa, Entacmaea quadricolor
MVSKGEELIKENMHMKLYMEGTVNNHHFKCTSEGEGKPYEGTQTQRIKVVEGGPLPFAFDILATSFMYGSKTFINHTQGIPDFFKQSFPEGFTWERVTTYEDGGVLKVKQDTSLQDGCLIYNVKIRGVNFPSNGPVMQKKTLGWEANTETLYPADGGLRGYNTMALKLVGGGHLQTFLKTTYRSKKPAKNLKMPGVYFVDRRLERIKEADKETYVEQHEVAVARYCDLPSKLGHKLNGMDELYK

SEQ ID NO: 532 - protein, 316 aa, Rhodopseudomonas palustris
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRRTNSAIRRLQAAETLESACAAAAQEVRKITGFDRVMIYRFASDFSGSVIAEDRCAEVESKLGLHYPASFIPAQARRLYTINPVRIIPDINYRPVPVTPDLNPVTGRPIDLSFAILRSVSPNHLEFMRNIGMHGTMSISILRGERLWGLIVCHHRTPYYVDLDGRQACELVAQVLAWQIGVMEE

SEQ ID NO: 533 - protein, 316 aa, Rhodopseudomonas palustris
MAEGSVARQPDLLTCDDEPIHIPGAIQPHGLLLALAADMTIVAGSDNLPELTGLAIGALIGRSAADVFDSETHNRLTIALAEPGAAVGAPITVGFTMRKDAGFIGSWHRHDQLIFLELEPPQRDVAEPQAFFRHTNSAIRRLQAAETLESACAAAAQEVRKITGFDRVMIYRFASDFSGEVIAEDRCAEVESKLGLHSPASYIPAQARRLYTINPVRIIPDINYRPVPVTPDLNPVTGRPIDLSFAILRSVSPVHLEFMRNIGMHGTMSISILRGERLWGLIVCHHRTPYYVDLDGRQACELVAQVLARAIGVMEE

SEQ ID NO: 534 - protein, 106 aa, Arabidopsis thaliana
MEKSFVITDPRLPDNPIIFASDGFLELTEYSREEILGRNGRFLQGPETDQATVQKIRDAIRDQREITVQLINYTKSGKKFWNLLHLQPMRDQKGELQYFIGVLLDG

SEQ ID NO: 535 - protein, 244 aa, Entacmaea quadricolor
MVSKGEELIKENMHMKLYMEGTVNNHHFKCTSEGEGKPYEGTQTGRIKVVEGGPLPFAFDILAPCFMYGSKTFINHTQGIPDFFKQSFPEGFTWERVTTYEDGGVLTVTQDTSLQDGCLIYNVKLRGVNFPSNGPVMQKKTLGWEASTETLYPADGGLEGRCDWALKLVGGGHLHCNLKTTYRSKKPAKNLKMPGVYFVDRRLERIKEADNETYVEQHEVAVARYCDLPSKLGHKLNGMDELYK

SEQ ID NO: 536 - protein, 242 aa, Aequorea coerulescens
MSKGAELFTGIVPILIELNGDVNGHKFSVSGEGEGDATYGKLTLKFICTTGKLPVPWPTLVATLSYGVQCFSRYPDHMKQHDFFKSAMPEGYIQERTIFFEDDGNYKSRAEVKFEGDTLVSRIELTGTDFKEDGNILGNKMEYNYNATNVYIMTDKARNGIKVNFKVRHNIKDGSVQLADHYQQNTPIGDGPVLLPDNHYLSTQSALSKDPNEKRDHMIYLEFVTAAAITHGMDELYKWKLN

SEQ ID NO: 537 - protein, 238 aa, Aequorea victoria
MSKGEELFTGVVPILVELDGDVNGHKFSVSGEGEGDATYGKLTLKFICTTGKLPVPWPTLVTTFSHGVQCFSRYPDHMKQHDFFKSAMPEGYVQERTIFFKDDGNYKTRAEVKFEGDTLVNRIELKGIDFKEDGNILGHKLEYNFNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 538 - protein, 236 aa, Discosoma
MVSKGEEDNMAIIKEFMRFKVHMEGSVNGHEFEIEGEGEGRPYEGTQTAKLKVTKGGPLPFAWDILSPQFLFGSRAYVKHPADIPDYLKLSFPEGFKWERVMNFEDGGVVTVTQDSSLQDGEFIYKVKLRGTNFPSDGPVMRRKTMGWEASSERMCPEDGALKGEIKLRLKLRDGGHYDAEVKTTYKAKKPVQLPGAYNVNIKLDITSHNEDYTIVEQYERAEGRHSTGGMDELYK

SEQ ID NO: 539 - protein, 225 aa, Echinophyllia echinata
MSLINPEMKIKLLMEGNVNGHPFVIEGDGKGHPFEGKQSMDLVVKEGAPLPFAYDILTTAFHYGNRVFAKYPDHIPDYFKQSFPNGFSWERSLMFEDGGVCIATNDITLEGDTFFNKVRFYGVNFPPNGPVMQKKTLKWEASTEKMYLRDGVLTGDITMALLLKGDVHYRCDFRTTYKSRQEGVKLPGYHFVDHCISIVSHDKDYTKVKLYEHAVAHLGLPENVK

SEQ ID NO: 540 - protein, 238 aa, Aequorea victoria
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSCQSALSKDPNEKRDHMVLLEFVTAAGITHGMDELYK

SEQ ID NO: 541 - protein, 236 aa, Discosoma sp.
MVSKGEEDNMAIIKEFMRFKVHLEGSVNGHEFEIEGEGEGRPYEGTQTAKLKVTKGGPLPFTWDILSPQFMYGSNAYVKHPADIPDYFKLSFPEGFKWERVMNFEDGGVVTVTQDSSLQDGEFIYKVKLRGTNFPSDGPVIQKKTMGWDALSERMYPEDGALKGELKARLKLKDGGHYEAEVKTTYKAKKPVQLPGAYNVNRKLDITSHNEDYTIVEQYERAEGRHSTGGMDELYK

SEQ ID NO: 542 - protein, 236 aa, Discosoma sp.
MVSKGEEDNMAIIKEFMRFKSHMEGSVNGHEFEIEGEGEGRPYEGTQTCKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEPSSERMYPEDGALKGEGKGRLKLKDGGHYDAEVKTTYKAKKPVQLPGAYNCNIKLDITSHNEDYTIVEQYERAEGRHSTGGMDELYK

SEQ ID NO: 543 - protein, 238 aa, Aequorea victoria
MSKGEELFTGVVPILVELDGDVNGHKFSVSGEGEGDATYGKLTLKFICTTGKLPVPWPTLVTTFTYGVQCFSRYPDHMKRHDFFKSAMPEGYVQERTIFFKDDGNYKTRAEVKFEGDTLVNRIELKGIDFKEDGNILGHKLEYNYNSGNVYIMADKQKNGIKVNFKIRHNIEDGSVQLADHYQQNTPIGDGPVLLPDNHYLSCQSALSKDPNEKRDHMVLLEFVTAAGITHGMDELYK

SEQ ID NO: 544 - protein, 233 aa, Entacmaea quadricolor
MSELIKENMHMKLYMEGTVNNHHFKCTSEGEGKPYEGTQTMRIKVVEGGPLPFAFDILATSFMYGSKTFINHTQGIPDFWKQSFPEGFTWERVTTYEDGGVLTATQDTSLQDGCLIYNVKIRGVNFPSNGPVMQKKTLGWEANTEMLYPADGGLEGRGDMALKLVGGGHLICNLKTTYRSKKPAKNLKMPGVYYVDRRLERIKEADKETYVEQHEVAVARYCDLPSKLGHKLN

SEQ ID NO: 545 - protein, 233 aa, Entacmaea quadricolor
MSELIKENMHMKLYMEGTVNNHHFKCTSEGEGKPYEGTQTMRIKVVEGGPLPFAFDILATSFMYGSYTFINHTQGIPDFFKQSFPEGFTWERVTTYEDGGVLTATQDTSLQDGCLIYNVKIRGVNFTSNGPVMQKKTLGWEAGTEMLYPADGGLEGRSDDALKLVGGGHLICNLKSTYRSKKPAKNLKVPGVYYVDRRLERIKEADKETYVEQHEVAVARYCDLPSKLGHKLN

SEQ ID NO: 546 - protein, 335 aa, Deinococcus radiodurans
MASMTGGQQMGRGSMSRDPLPFFPPLYLGGPEITTENCEREPIHIPGSIQPHGALLTADGHSGEVLQMSLNAATFLGQEPTVLRGQTLAALLPEQWPALQAALPPGCPDALQYRATLDWPAAGHLSLTVHRVGELLILEFEPTEAWDSTGPHALRNAMSALESAPNLRALAEVATQTVRELTGFDRVMLYKFAPDATGEVIAEARREGLHAFLGHRFPASHIPAQARALYTRHLLRLTADTRAAAVPLDPVLNPQTNAPTPLGGAVLRATSPMHMQFLRNMGVGSSLSVSVVVGGQLWGLIACHHQTPYVLPPDLRTTLEYLGRELSEQVQVKEA

SEQ ID NO: 547 - protein, 232 aa, Entacmaea quadricolor
MVSELIKENMPMKLYMEGTVNNHHFKCTSEGEGKPYEGTQTMRIKVVEGGPLPFAFDILATSFMYGSKTFIKHPPGIPDFFKQSFPEGFTWERVTTYEDGGVLTATQDTSLQDGCLIYNVKVRGVNFPANGPVMQKKTLGWEAHTETMYPADGGLEGACDMALKLVGGGHLICNLETTYRSKKPATNLKMPGVYNVDHRLERIKEADDETYVEQHEVAVARYSTGGAGDGGK

SEQ ID NO: 548 - protein, 315 aa, Rhodopseudomonas palustris
MVAGHASGSPAFGTASHSNCEHEEIHLAGSIQPHGALLVVSEHDHRVIQASANAAEFLNLGSVLGVPLAEIDGDLLIKILPHLDPTAEGMPVAVRCRIGNPSTEYCGLMHRPPEGGLIIELERAGPSIDLSGTLAPALERIRTAGSLRALCDDTVLLFQQCTGYDRVMVYRFDEQGHGLVFSECHVPGLESYFGNRYPSSFIPQMARQLYVRQRVRVLVDVTYQPVPLEPRLSPLTGRDLDMSGCFLRSMSPIHLQFLKDMGVRATLAVSLVVGGKLWGLVVCHHYLPRFIRFELRAICKRLAERIATRITALES

SEQ ID NO: 549 - protein, 234 aa, Entacmaea quadricolor
MGEDSELISENMHTKLYMEGTVNGHHFKCTSEGEGKPYEGTQTCKIKVVEGGPLPFAFDILATSFMYGSKTFINHTQGIPDFFKQSFPEGFTWERITTYEDGGVLTATQDTSLQNGCLIYNVKINGVNFPSNGPVMQKKTLGWEANTEMLYPADSGLRGHNQMALKLVGGGYLHCSLKTTYRSKKPAKNLKMPGFYFVDRKLERIKEADKETYVEQHEMAVARYCDLPSKLGHS

SEQ ID NO: 550 - protein, 236 aa, Discosoma sp.
MVSKGEENNMAVIKEFMRFKVRMEGSVNGHEFEIEGEGEGRPYEGTQTAKLKVTKGGPLPFAWDILSPQFCYGSKAYVKHPTGIPDYFKLSFPEGFKWERVMNFEDGGVVTVAQDSSLQDGEFIYKVKLRGTNFPSDGPVMQKKTMGWEASSERMYPEDGALKGEIKMRLKLKDGGHYSAETKTTYKAKKPVQLPGAYIAGEKIDITSHNEDYTIVELYERAEGRHSTGGMDELYK

SEQ ID NO: 551 - protein, 239 aa, Aequorea victoria
MASKGEELFTGVVPILVELDGDVNGHKFSVSGEGEGDATYGKLTLKFICTTGKLPVPWPTLVTTLSHGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 552 - protein, 237 aa, Entacmaea quadricolor
MVSKGEELIKENMHMKLYMEGTVNNHHFKCTSEGEGKPYEGTQTMRIKVVEGGPLPFAFDILATSFMYGSRTFINHTQGIPDFWKQSFPEGFTWERVTTYEDGGVLTATQDTSLQDGCLIYNVKLRGVNFPSNGPVMQKKTLGWEAATEMLYPADGGLEGRGDMALKLVGGGHLICNLKTTYRSKNPAKNLKMPGVYFVDHRLERIKEADKETYVEQHEVAVARYCDLPSKLGHKLN

SEQ ID NO: 553 - protein, 238 aa, Aequorea victoria
MSKGEELFTGVVPILVELDGDVNGHKFSVSGEGEGDATYGKLTLKFISTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSCNVYIMADKQKNGIKVNFKIRHNIEDGSVQLADHYQQNTPIGDGPVLLPDNHYLSCQSALSKDPNEKRDHMVLLEFVTAAGITHGMDELYK

SEQ ID NO: 554 - protein, 239 aa, Aequorea victoria
MASKGEELFTGVVPILVELDGDVNGHKFSVSGEGEGDATYGKLTLKFICTTGKLPVPWPTLVTTLSHGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 555 - protein, 148 aa, Pseudomonas putida
MINAKLLQLMVEHSNDGIVVAEQEGNESIMIYVNPAFERLTGYCADDILYQDARFLQGEDHDQPGIAIIREAIREGRPCCQVLRNYRKDGSLFWNELSITPVHNEADQLTYYIGIQRDVTAQVFAEERVRELEAEVAELRRQQGQAKH

SEQ ID NO: 556 - protein, 236 aa, Discosoma sp.
MVSKGEEDNMAIIKEFMRFKTHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLHGTNFPSDGPVMQKKTMGWEASSERMYPEDGAMKGEIKLRLKLKDGGHYDAEVKTTYKAKKPVQLPGAYNANYKLDITSHNEDYTIVEQYERCEGRHSTGGMDELYK

SEQ ID NO: 557 - protein, 222 aa, Montipora sp. 20
MVSVIAKQMTYKVYMSGTVNGHYFEVEGDGKGKPYEGEQTVKLTVTKGGPLPFAWDILSPQLQYGSIPFTKYPEDIPDYFKQSFPEGYTWERSMNFEDGAVCTVSNDSSIQGNCFIYNVKISGENFPPNGPVMQKKTQGWEPSTERLFARDGMLIGNDYMALKLEGGGHYLCEFKSTYKAKKPVRMPGRHEIDRKLDVTSHNRDYTSVEQCEIAIARHSLLG

SEQ ID NO: 558 - protein, 239 aa, Aequorea victoria
MVSKGEELFTGVVPILVELDGDVNGHKFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 559 - protein, 320 aa, Deinococcus radiodurans
MSRDPLPFFPPLYLGGPEITTENCEREPIHIPGSIQPHGALLTADGHSGEVLQMSLNAATFLGQEPTVLRGQTLAALLPEQWPALQAALPPGCPDALQYRATLDWPAAGHLSLTVHRVGELLILEFEPTEAWDSTGPHALRNAMSALESAPNLRALAEVATQTVRELTGFDRVMLYKFAPDATGEVIAEARREGLHAFLGHRFPASLIPAQARALYTRHLLRLTADTRAAAVPLDPVLNPQTNAPTPLGGAVLRATSPMHMQFLRNMGVRSSLSVSVVVGGQLWGLIACHHQTPYVLPPDLRTTLEYLGRELSEQVQVKE

SEQ ID NO: 560 - protein, 222 aa, Montipora sp. 20
MVSVIAKQMTYKVYMSGTVNGHYFEVEGDGKGKPYEGEQTVKLTVTKGGPLPFAWDILSPLFQYGSIPFTKYPEDIPDYVKQSFPEGYTWERTMNFEDGAVCTVSNDSSIQGNCFIYNVKISGVNFPPNGPVMQKKTQGWEPSTERLFARDGMLIGNDYMALKLEGGGHYLCEFKSTYKAKKPVRMPGYHYVDRKLDVTSHNRDYTSVEQCEIAIARHSLLG

SEQ ID NO: 561 - protein, 148 aa, Pseudomonas putida
MINAKLLQLMVEHSNDGIVVAEQEGNESILIYVNPAFERLTGYCADDILYQDARFLQGEDHDQPGIAIIREAIREGRPCCQVLRNYRKDGSLFWNELSITPVHNEADQLTYYIGIQRDVTAQVFAEERVRELEAEVAELRRQQGQAKH

SEQ ID NO: 562 - protein, 232 aa, Entacmaea quadricolor
MVSELIKENMPMKLYMEGTVNNHHFKCTSEGEGKPYEGTQTMRIKVVEGGPLPFAFDILATSFMYGSKTFIKHPPGIPDFFKQSFPEGFTWERVTTYEDGGVLTATQDTSLQDGCLIYNVKVRGVNFPANGPVMQKKTLGWEAHTETMYPADGGLEGACDMALKLVGGGHLIANLETTYRSKKPATNLKMPGVYNVDHRLERIKEADDETYVEQHEVAVARYSTGGAGDGGK

SEQ ID NO: 563 - protein, 233 aa, Entacmaea quadricolor
MSELIKENMHMKLYMEGTVNNHHFKCTSEGEGKPYEGTQTMRIKVVEGGPLPFAFDILATSFMYGSYTFINHTQGIPDFFKQSFPEGFTWERVTTYEDGGVLTATQDTSLQDGCLIYNVKIRGVNFTSNGPVMQKKTLGWEAGTEMLYPADGGLEGRSDEALKLVGGGHLICNLKSTYRSKKPAKNLKVPGVYYVDRRLERIKEADKETYVEQHEVAVARYCDLPSKLGHKLN

SEQ ID NO: 564 - protein, 232 aa, Aequorea victoria
MNCGALLFKQKIPFIVELDGDVNGQVFSVRGNGFGDGSIGKIEIKFVCTTGEIPVAWESLVCSLAYGALVFTKYPSNINDFFKSTMPKGYIQERKITFENDGQYETRAEVTYENGALYNRVKLNGSGFRKDGNILGKKLDATSLGTCIYILSNDEGNGLKGVYNMAYKVIDGNRQIVSHQQTNTPIGDGLVSIPDYHVMHNHISCSKDPTEPRDHLILKESVTAVDCQTAYM

SEQ ID NO: 565 - protein, 222 aa, Montipora sp. 20
MVSVIAKQMTYKVYMSGTVNGHYFEVEGDGKGKPYEGEQTVKLTVTKGGPLPFAWDILSPLMCYGSIPFTKYPEDIPDYVKQSFPEGYTWERTMNFEDGAVCTVSNDSSIQGNCFIYNVKISGTNFPPNGPVMQKKTQGWEPSTERLFARDGMLIGNDYMALKLEGGGHYLCEFKSTYKAKKPVRMPGYHYIDRKLDVTSHNRDYTSVEQCEIAIARHSLLG

SEQ ID NO: 566 - protein, 225 aa, Discosoma sp.
MASSEDVIKEFMRFKVRMEGSVNGHEFEIEGEGEGRPYEGTQTAKLKVTKGGPLPFAWDILSPQFMWGSKAYVKHPADIPDYLKLSFPEGFKWERVMNFEDGGVVTVTQDSSLQDGEFIYKVKLRGTNFPSDGPVMQKKTMGWAATTERMYPEDGALKGEIKMRLKLKDGGHYDAEVKTTYMAKKPVQLPGAYKIDGKLDITSHNEDYTIVEQYERAEGRHSTGA

SEQ ID NO: 567 - protein, 241 aa, Aequorea victoria
DPMVSKGEELFTGVVPILVELDGDVNGHKFSVSGEGEGDATYGKLTLKFILTTGKLPVPWPTLVTTFGYGLMVFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITHGMDELYK

SEQ ID NO: 568 - protein, 244 aa, Entacmaea quadricolor
MVSKGEELIKENMHMKLYMEGTVNNHHFKCTSEGEGKPYEGTQTQRIKVVEGGPLPFAFDILATCFMYGSKTFINHTQGIPDFFKQSFPEGFTWERVTTYEDGGVLTATQDTSLQDGCLIYNVKIRGVNFPSNGPVMQKKTLGWEANTETLYPADGGLRGHNQMALKLVGGGHLICNLKTTYRSKKPAKNLKMPGVYFVDRRLERIKEADKETYVEQHEVAVARYCDLPSKLGHKLNGMDELYK

SEQ ID NO: 569 - protein, 225 aa, Discosoma sp.
MASSEDVIKEFMRFKVRMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERLYPEDGALKGEIKMRLKLKDGGHYDAEAKTTYMAKKPVQLPGAYKLDYKLDITSHNEDYTIVEQYERAEGRHSTGA

SEQ ID NO: 570 - protein, 219 aa, Heteractis crispa
MLLKENMHIRMYMEGTVNGHYFKCKGVGDGNPFAGTQSMRVHVTEGAPLPFAFDILAPCCEYGSKTFVRYPADIPDFFKQSFPEGFTWERTTTYEDGGILTAHQDTSLEGNCLIYKVEVHGTNFPADGPVMKKETCGWEPSTESVYPENGVLRGRNHMALKVGDSHLHCHHSTTYRSKKAERALIMPPRHSTDYCLQITSRKDDEYFELHETSVARYSD

SEQ ID NO: 571 - protein, 236 aa, Discosoma sp.
MVSKGEENNMAVIKEFMRFKTHMEGSVNGHEFEIEGKGEGRPYEGTQTAKLKVTKGGPLPFAWDILSPQMMYGSKAYVKHPPDIPDYMKLSFPEGFKWERVMNFEDGGVVTVTQDSSLQDGEFIYKVKLHGTNFPSDGPVMQKKTMGWEASSERLYPEDGALKGEVKMRLKLKDGGHYDAEVKTTYMAKKPVQLPGAYKLDYKLDITSHNEDYTIVEQYERAEGRHSTGGMDELYK

SEQ ID NO: 572 - protein, 244 aa, Entacmaea quadricolor
MVSKGEELIKENMHMKLYMEGTVNNHHFKCTSEGEGKPYEGTQTQRIKVVEGGPLPFAFDILATCFMYGSKTFINHTQGIPDFFKQSFPEGFTWERVTTYEDGGVLTATQDTSLQDGCLIYNVKIRGVNFPSNGPVMQKKTLGWEANTETLYPADGGLRGHNPMALKLVGGGHLICNLKTTYRSKKPAKNLKMPGVYFVDRRLERIKEADKETYVEQHEVAVARYCDLPSKLGHKLNGMDELYK

SEQ ID NO: 573 - protein, 219 aa, Heteractis crispa
MLLKENMHIKMYMEGTVNGHYFKCKGEGDGNPFAGTQSMRVHVTEGAPLPFAFDILAPCCEYGSKTFVRYPADIPDFFKQSFPEGFTWERTTTYEDGGILTAHQDTSLEGNCLIYKVKVHGTNFPADGPVMKKETCGWEPSTESVYPENGVLRGRNHMALKVGDSHLHCHHSTTYRSKKAERALIMPPRHSTDYCLQITSHKDDEYFELYETSVARYSD

SEQ ID NO: 574 - protein, 236 aa, Discosoma sp.
MVSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEASSERMYPEDGALKGEGKGRLKLKDGGHYDAEVKTTYKAKKPVQLPGAYNCNYKLDITSHNEDYTIVEQYERAEGRHSTGGMDELYK

SEQ ID NO: 575 - protein, 236 aa, Discosoma sp.
MVSKGEENNMAVIKEFMRFKVRMEGSVNGHEFEIEGKGEGRPYEGTQTAKLKVTKGGPLPFAWDILSPQFMYGSKAYVKHPPDIPDYMKLSFPEGFKWERVMNFEDGGVVTVTQDSSLQDGEFIYKVKLHGTNFPSDGPVMQKKTMGWEASSERLYPEDGALKGEVKMRLKLKDGGHYDAEVKTTYMAKKPVQLPGAYKLDYKLDITSHNEDYTIVEQYERAEGRHSTGGMDELYK

SEQ ID NO: 576 - protein, 236 aa, Discosoma sp.
MVSKGEEDNMAIIKEFMRFKTHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLHGTNFPSDGPVMQKKTMGWEASSERMYPEDGALKGEIKLRLKLKDGGHYDAEVKTTYKAKKPVQLPGAYNANYKLDITSHNEDYTIVEQYERCEGRHSTGGMDELYK

SEQ ID NO: 577 - protein, 239 aa, Aequorea victoria
MVSKGEELFTGVVPILVELDGDVNGHKFSVSGEGEGDATYGKLTLKFICTTGKLPVPWPTLVTTLSHGLQCFARYPDHMKQHDFFKSAMPEGYVQERTIFFKDDGNYKTRAEVKFEGDTLVNRIELKGIDFKEDGNILGHKLEYNFNSHNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 578 - protein, 236 aa, Discosoma sp.
MVSKGEEDNMAIIKEFMRFKTHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEACSERMYPEDGALKGEMKMRLKLKDGGHYDAEVKTTYKAKKPVQLPGAYNTNTKLDITSHNEDYTIVEQYERNEGRHSTGGMDELYK

SEQ ID NO: 579 - protein, 238 aa, Aequorea victoria
MSKGEELFTGVVPILVELDGDVNGHKFSVSGEGEGDATYGKLTLKFICTTGKLPVPWPTLVTTFSHGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 580 - protein, 236 aa, Discosoma sp.
MVSKGEEDNMAIIKEFMRFKSHMEGSVNGHEFEIEGEGEGRPYEGTQTCKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWEPSSERMYPEDGALKGEGKGRLKLKDGGHYDAEVKTTYKAKKPVQLPGAYNCNYKLDITSHNEDYTIVEQYERAEGRHSTGGMDELYK

SEQ ID NO: 581 - protein, 170 aa, Sander vitreus
MFIKPGRCPKPAVQEDFDAARYLGVWYDIQRLPNKFQKGECATATYSLSPGVGFSVFNRERLANGTIKSVIGSAIAEDPCEPAKLQFFHENAAPVPYWVLSTDYDNYALVYSCINLGASHAAYASIVSRQPTLPEETIKKLQGTMSSFGVGVDTLLTTNQDAAYCSAMNQ

SEQ ID NO: 582 - protein, 227 aa, Heteractis crispa; identical to SEQ ID NO: 92

SEQ ID NO: 583 - protein, 221 aa, Montipora efflorescens
MSVIATQMTYKVYMSGTVNGHYFEVEGDGKGRPYEGEQTVKLTATKGGPLPFAWDILSPQCQYGSIPFTKYPEDIPDYVKQSFPEGFTWERIMNFEDGAVCTVSNDSSIQGNCFTYHVKFRGLNFPPNGPVMQKKTQGWEPHSERLFARGGMLIGNNRMALKLEGGGHYLCEFKTTYKAKKPVKMPGYHYVDRKLDVTNHNKDYTSVEQCEISIARKPVVA

SEQ ID NO: 584 - protein, 232 aa, Anthoathecata
MEGGPALFQSDMTFKIFIDGVVNDQKFTIIADGSSKFPHGDFNVHAVCETGKLPMSWKPICHLIQYGEPFFAKYPNGISHFAQECFPEGLTIDRTVRFENDGTMTSHHTYELDGTCVISRITVNCDGFQPDGPIMKDQLVDILPTETHMFPHGSNAVRQLCYIGFTTADGGLMMSHFDSKLTFNGSRAIKIPGPHFVTVIIKQMKDTSDKRDHVCQREVTYAHSVPRITSAI

SEQ ID NO: 585 - protein, 221 aa, Montipora efflorescens
MSVIATQMTYKVYMSGTVNGHYFEVEGDGKGRPYEGEQTVKLTATKGGPLPFAWDILSPQCQYGSIPFTKYPEDIPDYVKQSFPEGFTWERIMNFEDGAVCTVSNDSSIQGNCFTYHVKFRGTNFPPNGPVMQKKTQGWEPNSERLFARGGMLIGNNRMALKLEGGGHYLCEFKTTYKAKKPVKMPGYHYVDRKLDVTNHNKDYTSVEQCEISIARKPVVA

SEQ ID NO: 586 - protein, 238 aa, Aequorea victoria
MSKGEELFTGVVPILVELDGDVNGHKFSVSGEGEGDATYGKLTLKFICTTGKLPVPWPTLVTTLGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITHGMDELYK

SEQ ID NO: 587 - protein, 238 aa, Aequorea victoria
MSKGEELFTGVVPILVELDGDVNGHKFSVSGEGEGDATYGKLTLKFICTTGKLPVPWPTLVTTFGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSWQSALSKDPNEKRDHMVLLEFVTAAGITHGMDELYK

SEQ ID NO: 588 - protein, 224 aa, Echinophyllia sp.
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICIATNDITLDGDCFIYEIRFDGVNFPANGPVMQKRTVKWEPSTEKLYVRDGVLKGDVNMALLLEGGGHYRCDFKTTYKAKKVVQLPDYHFVDHRIEIKSHDKDYNNVNLHEHAEAHSGLPRQAK

SEQ ID NO: 589 - protein, 228 aa, Aequorea victoria
SKGEELFTGVVPILVELDGDVNGHKFSVSGEGEGDATYGKLTLKFICTTGKLPVPWPTLVTTLGYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGI

SEQ ID NO: 590 - protein, 238 aa, Aequorea victoria
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSHQSALSKDPNEKRDHMVLLEFVTAAGITHGMDELYK

SEQ ID NO: 591 - protein, 238 aa, Aequorea victoria
MSKGEELFTGVVPILVELDGDVNGHKFSVSGEGEGDATYGKLTLKFICTTGKLPVPWPTLVTTFTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITHGMDELYK

SEQ ID NO: 592 - protein, 232 aa, Acropora millepora
MALSKHGLTKDMTMKYHMEGSVDGHKFVITGHGDGNPFEGKQTINLCVAEGGPLPFSEDILSAAFDYGNRVFTEYPQGMVDFFKNSCPAGYTWHRSLLFEDGAVCTTSADITVSVEENCFYHNSKFHGVNFPADGPVMKKMTTNWEPSCEKIIPVPRQGILKGDIAMYLLLKDGGRYRCQFDTIYKAKSDPKEMPEWHFIQHKLTREDRSDAKNQKWQLVEHAVASRSALPG

SEQ ID NO: 593 - protein, 237 aa, Anthoathecata
MEGGPALFQSDMTFKIFIDGEVNGQKFTIVADGSSKFPHGDFNAHAVCETGKLPMSWKPICHLIQYGEPFFARYPDGISHFAQECFPEGLSIDRTVRFENDGTMTSHHTYELDDTCVVSRITVNCDGFQPDGPIMRDQLVDILPNETHMFPHGPNAVRQLAFIGFTTADGGLMMGHFDSKMTFNGSRAIEIPGPHFVTIITKQMRDTSDKRDHVCQREVAYAHSVPRITSAIGSDED

SEQ ID NO: 594 - protein, 221 aa, Acropora aculeus
MSVIAKQMTYKVYMSGTVNGHYFEVEGDGKGKPYEGEQTVKLTVTKGGPLPFAWDILSPQSQYGSIPFTKYPDDIPDYVKQSFPEGYTWERIMNFEDGAVCTVSNDSSIQGNCFIYNVKFSGLNFPPNGPVMQKKTQGWEPNTERLFARDGMLIGNNFMALKLEGGGHYLCEFKSTYKAKKPVRMPGYHYVDRKLDVTNHNRDYTSVEQCEISIARKPVVA

SEQ ID NO: 595 - protein, 232 aa, Aequorea australis
MACGALLFKGKIPFVVELEGDVNGEVFSVRGNGWGDGSTGKLEIKFVCTTGEVPLAWESLICSMAYGALVFCKYPSNINDFFKSTMPRGYIQERKISYENDGTFDVRQEVTYENGALYNRVKFNGSGFRKDGNVLGKKLDLTSIGTCIYIMGNDEGTGLKGVFNKAFKVIGGNRQIASHVQTQTPIGDGLVSIPDYHVMHNHIACSKDPSETRDHIIVKESLRAVDCNTEYM

SEQ ID NO: 596 - protein, 232 aa, Aequorea australis
MACGALLFKGKIPFVVELEGDVNGEVFSVRGNGWGDGSTGKIEIKFVCTTGEIPVAWESLVCSLAYGALVFAKYPSNINDFFKSTMPKGYIQERNIQFENDGQYVTRAEVTYENGTLYNRVKLNGSGFRKDGNILGKKLDSTSLGTCIYIMGNDQGNGLKGVYNKAYKVIGGNRQLASHQQTHTPIGDGLVSIPDYHVMHNHIACSKDPSETRDHIIVKESLRAVDCNTEYM

SEQ ID NO: 597 - protein, 232 aa, Aequorea australis
MNCGALLFQQKVPFIVEMEGDVNGEIFSVRGNGFGNATTGKLDILFVCTTGEIPVAWESLISSLAYGAFVFAKYPSNIADFFKSTMPEGYIQERKVTFENDGTYETHATVTYENGAIFERVKLTGTGFREDGNILGKKLEITSLGTPLSIMADDEGKGLRSVFNQAIKVVGGNRQIAIHEQRNRPIGDGLISVPDYHTLHNHLKCSKVSTEKRDHMMVNETLKAIDCQTAYL

SEQ ID NO: 598 - protein, 175 aa, Anthoathecata
  MISC_FEATURE (114)...(114): Xaa is any amino acid
  MISC_FEATURE (116)...(116): Xaa is any amino acid
  MISC_FEATURE (128)...(128): Xaa is any amino acid
  MISC_FEATURE (135)...(135): Xaa is any amino acid
AIKPDMKIKLCMEGAVNGHPFMIEGEGKGKPFDGKQNMELKVKEGGPLPFAYDILTTVFNYGNRVFAKYPRDIADYFKQSFPEGFSWERSMAYEDGGICIATNNITLMKGDCFXYXIRFDGVNFPANXPVMQKKXVKWEPSTEKLYVRDGVLKGDINMALLLEGGGHYRCDFKTT

SEQ ID NO: 599 - protein, 238 aa, Aequorea coerulescens
MSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMILFEFVTAAAITHGMDELYK

SEQ ID NO: 600 - protein, 237 aa, Aequorea coerulescens
SKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 601 - protein, 239 aa, Aequorea victoria
MVSKGEELFTGVVPILVELDGDVNGHKFSVRGEGEGDATIGKLTLKLICTTGKLPVPWPTLVTTLGYGLAVFARYPDHMKQHDFFKSAMPEGYVQERTIFFKDDGNYKTRAEVKFEGDTLVNRIELKGSGFKEDGNILGHKLEYNFNSHNVYITADKQKNGIKANFKIRHNIEDGGVQLADHYQQNTPIGDGPVLLPDNHYLSYQSFLSKDPNEKRDHMVLLEFVTAAGITLGMDELYK

SEQ ID NO: 602 - protein, 231 aa, Acropora digitifera
MALSKHGLTKDMTMKYRMEGCVDGHKFVITGHGNGSPFEGKQTINLCVVEGGPLPFSEDILSAVFDYGNRVFTDYPQGMVDFFKNSCPAGYTWQRSLLFEDGAVCTASADITVSVEENCFYHESKFHGVNFPADGPVMKKMTINWEPCCEKIIPVPRQGILKGDVAMYLLLKDGGRYRCQFDTVYKAKTDSKKMPEWHFIQHKLTREDRSDAKNQKWQLAEHSVASRSALP

SEQ ID NO: 603 - protein, 231 aa, Acropora digitifera
MALSKHGLTKDMTMKYRMEGCVDGHKFVITGHGNGSPFEGKQTINLCVVEGGPLPFSEDILSAVFDYGNRVFTDYPQGMVDFFKNSCPAGYTWQRSLLFEDGAVCTASADITVSVEENCFYHESKFHGVNFPADGPVMKKMTINWEPSCEKIIPVPRQGILKGDVAMYLLLKDGGRYRCQFDTVYKAKTDSKKMPEWHFIQHKLTREDRSDAKNQKWQLAEHSVASRSALP

SEQ ID NO: 604 - protein, 221 aa, Acropora hyacinthus
MSVIATQMTYKVYMSGTVNGHYFEVEGDGKGKPYEGEQTVRLTVTKGGPLPFAWDILSPQSQYGSIPFTKYPEDIPDYVKQSFPEGYTWERIMNFEDGAVCTVSNDSSIQGNCFIYHVKFSGLNFPPNGPVMQKKTQGWEPNTERLFARDGVLIGNNFMALKLEGGGHYLCEFKSTYKAKKPVKMPGYHFVDRKLDVTNHNKDYTSVEQREISIARKPVVA

SEQ ID NO: 605 - protein, 223 aa, Astrangia lajollaensis
MSLSKQVIGKEMNMTYLMDGSVNGHNFTVEGEGDGKPYEGHQCLKLRITKGEPLPFAFDILTAAFCYGNRCFVNYPAEIADYFKQAFPEGLTWERSMTFEDGGFAAVSADISLNGNCFVHQSKFVGVNFPADGPVMQKKTVGWEPSTEKMIVRDGILEGDVTMYLKLEGGGNYRCEYRTIYKAKKDVKMPKSHFVEHTLVRNNIKKDAKGNTIELIEDASARY

SEQ ID NO: 606 - protein, 219 aa, Astrangia lajollaensis
MVLSKQMNMTYLMDGSVNGHNFTVEGEGDGKPYEGHQCLKLRITKGEPLPFAFDILTAAFCYGNRCFVNYPAEIADYFKQAFPEGLTWERSMTFEDGGFAAVSADLSLKNGNWFVHQSKFVGVNFPADGPVMQKKTVGWEPSTEKMIVRDGTLEGDVTMYLKLEGGGNYRCDYRTIYKAKKDVKMPKSHFVEHTLVRNNIKKDAKGNTIELIEDASARY

SEQ ID NO: 607 - protein, 226 aa, Astrangia lajollaensis
MALSKQEIKKEMTMDYVMDGCVNGHSFTVKGDGAGKPYEGHQRLSLHVTGGQPLPFAFDILSAAFAYGNRCFTKYPKEIPDMFKQAFPGGMSWERTMTFEDGGVASVSADISIEKDGCFKHRSKFVGVNFPVNGPVMQNKTRGWEPSIEKMTVRDGTLKGHVTMFLKLEGGGNYRCDFETTYKAKKAVKMLDSHFIEHRLVTTIRGNNVELQEDAEARNSGLGECK

SEQ ID NO: 608 - protein, 229 aa, Anemonia majano; identical to SEQ ID NO: 54

SEQ ID NO: 609 - protein, 229 aa, Anemonia majano
MALSNKFIGDDMKMTYHMDGCVNGHYFTVKGEGNGKPYEGTQTSTFKVTMANGGPLAFSFDILSTVFKYGNRCFTAYPTSMPDYFKQAFPDGMSYERTFTYEDGGVATASWEISLKGNCFEHKSTFHGVNFPADGPVMAKKTTGWDPSFEKMTVCDGILKGDVTAFLMLQGGGNYRCQFHTSYKTKKPVTMPPNHVVEHRIARTDLDKGGNSVQLTQHAVAHITSVVPF

SEQ ID NO: 610 - protein, 229 aa, Anemonia majano
MALSNKFIGDDMKMTYHMDGCVNGHYFTVKGEGNGKPYEGTQTSTFKVTMANGGPLAFSFDILSTVFKYGNRCFTAYPTSMPDYFKQAFPDGMSYERTFTYEDGGVATASWEISLKGNCFEHKSTFHGVNFPADGPVMAKKTTGWDPSFQKMTVCDGILKGDVTAFLMLQGGGNYRCQFHTSYKTKKPVTMPPNHVVEHRIARTDLDKGGNSVQLTEHAVAHITSVVPF

SEQ ID NO: 611 - protein, 229 aa, Anemonia majano
MALSNKFIGDDMKMTYHMDGCVNGHYFTVKGEGNGKPYEGTQTSTFKVTMANGGPLAFSFDILSTVFKYGNRCFTAYPTSMPDYFKQAFPDGMSYERTFTYEDGGVATASWEISLKGNCFEHKSTFHGVNFPADGPVMAKKTTGWDPSFEKMTVCDGILKGDVTAFLMLQGGGNYRCQFHTSYKTKKPVTMPPNHVVETRIARTDLDKGGNSVQLTEHAVAHITSVVPF

SEQ ID NO: 612 - protein, 221 aa, Acropora millepora
MSVIAKQMTYKVYMSGTVNGHYFEVEGDGKGKPYEGEQTVKLTVTKGGPLPFAWDILSPQCQYGSIPFTKYPEDIPDYVKQSFPEGYTWERIMNFEDGAVCTVSNDSSIQGNCFIYHVKFSGLNFPPNGPVMQKKTQGWEPNTERLFARDGMLLGNNFMALKLEGGGHYLCEFKTTYKAKKPVKMPGYHYVDRKLDVTNHNKDYTSVEQCEISIARKPVVA

SEQ ID NO: 613 - protein, 221 aa, Acropora millepora
MSVIAKQMTYKVYMSGTVNGHYFEVEGDGKGKPYEGEQTVKLTVTKGGPLPFAWDILSPQSQYGSIPFTKYPEDIPDYVKQSFPEGYTWERIMNFEDGAVCTVSNDSSIQGNCFIYHVKFSGLNFPPNGPVMQKKTQGWEPNTERLFARDGMLIGNNFMALKLEGGGHYLCEFKSTYKAKKPVKMPGYHYVDRKLDVTNHNKDYTSVEQREISIARKPVVA

SEQ ID NO: 614 - protein, 221 aa, Acropora millepora
MSVIAKQMTYKVYVSGTVNGHYFEVEGDGKGKPYEGEQTVRLAVTKGGPLPFAWDILSPQCQYGSIPFTKYPEDIPDYVKQSFPEGYTWERIMNFEDGAVCTVSNDSSIQGNCFIYHVKFSGLNFPPNGPVMQKKTQGWEPNTERLFARDGMLIGNNFMALKLEGGGHYLCEFKSTYKAKKPVKMPGYHYVDRKLDVTNHNKDYTSVEQREISIARKPVVA

SEQ ID NO: 615 - protein, 221 aa, Acropora millepora
MSVIAKQMTYKAYMSGTVNGHYFEVEGDGKGKPYEGEQTEKLTVTKGGPLPFAWDILSPQCQYGSIPFTKYPEDIPDYVKQSFPEGFTWERIMNFEDGAVCTVTNDSSIQGNCFIYHVKFSGLNFPPNGPVMQKKTQGWEPHSERLLARDGMLIGNNFMALKLEGGGHYLCEFKTTYKAKKPVKMPGYHYVDRKLDVTNHNKDYTSVEQREISIARKPVVA

SEQ ID NO: 616 - protein, 231 aa, Acropora millepora
MSYSKQGIVQEMKTKYHMEGSVNGHEFTIEGVGTGNPYEGTQMSELVITKPAGKPLPFSFDILSTVFQYGNRCFTKYPEGMTDYFKQAFPDGMSYERSFLYEDGGVATASWNIRLERDCFIHKSIYHGVNFPADGPVMKKKTIGWDKAFEKMTVSKDVLRGDVTEFLMLEGGGYHSCQFHSTYKPEKPVTLPPNHVVEHHIVRTDLGQRAKGFTVKLEEHAAAHVNPLKVK

SEQ ID NO: 617 - protein, 231 aa, Acropora millepora
MSYSKQGIVQAMKTKYHMEGSVNGHEFTIEGVGTGNPYEGTQMSELVITKPAGKPLPFSFDILSTVFQYGNRCFTKYPEGMTDYFKQAFPDGMSYERSFLFEDGGVATASWNIRLEGDCFIHKSIYHGVNFPADGPVMKKKTIGWEKSFEKMTVSKDVLRGDVTMFLMLEGGGYHRCQFHSTYKPEKPGTLPPNHVVEHHIVRTDLGQSAKGFTVKLEEHAAAHVNPLKVK

SEQ ID NO: 618 - protein, 227 aa, Acropora millepora
MSYSKQGIVQEMKTKYHMEGSVNGHEFTIEGVGTGYPYEGKQISELVIIKPAGKPLPFSFDILSSVFQYGNRCFTKYPADMPDYFKQAFPDGMSYERSFLFEDGAVATASWNIRLEGNCFIHKSIFHGVNFPADGPVMKKKTIDWDKSFEKMTVSKEVLRGDVTMFLMLEGGGSHRCQFHSTYKTEKPVTLPPNHVVEHQIVRTDLGQTAKGFTVKLEEHAAAHVSL

SEQ ID NO: 619 - protein, 231 aa, Acropora millepora
MSYSKQGIVQEMKTKYHMEGSVNGHEFTIEGVGTGYPYEGKQMSELVIIKPAGKPLPFSFDILSSVFQYGNRCFTKYPADMPDYFKQAFPDGMSYERSFLFEDGAVATASWKIRLEGNCFIHNSIFHGVNFPADGPVMKKKTIGWDKSFEKMTVSKEVLRGDVTMFLMLEGGGSHRCQFHSTYKTEKPVTLPPNHVVEHQIVRTDLGQSAKGFTVKLEAHAAAHVNPLKVK

SEQ ID NO: 620 - protein, 232 aa, Acropora millepora
MALSKHGLTKDMTMKYHMEGSVDGHKFVITGHGNGNPFEGKQTVNLCVAEGGPLPFSEDILSAAFDYGNRVFTEYPQGMVDFFKNSCPAGYTWHRSLLFEDGAVCTTSADITVSVEENCFYHNSKFHGVNFPADGPVMKKMTTNWEPSCEKIIPVPRQGILKGDIAMYLLLKDGGRYRCQFDTIYKAKSDPKEMPEWHFIQHKLTREDRSDAKNQKWQLVEHAVASRSALPG

SEQ ID NO: 621 - protein, 225 aa, Anthoathecata
MAEYFEKPLPYKVELEGDVDGQKFTVIGEGQGDASTGRVEGKYVCTKGEVPISWVSLITSLSYGGKCFVRYPNVIKDFFKSTFPTGYHQERKITYEDDGVLETAAKVTLESGAIYNRISVKGVGFKKDGNVCKKRLHSSPPQVSYVVPYGEGIRVLYSNIYPTKDGGYVVADTRQVNRPIKAEGKSAIPKYHYIKSKIDLSTDPNERKDHIIIKEVNVASGIDFS

SEQ ID NO: 622 - protein, 221 aa, Acropora pulchra
MSVIAKQMTYKVYMSGTVNGHYFEVEGDGKGKPYEGEQTVRLAVTKGGPLPFAWDILSPQCQYGSIPFTKYPEDIPDYVKQSFPEGYTWERIMNFEDGAVCTVSNDSSIQGNCFIYHVKFSGLNFPPNGPVMQKKTQGWEPNTERLFARDGMLIGNNFMALKLEGGGHYLCEFKSTYKAKKPVKMPGYHYVDRKLDVTNHNKDYTSVEQCEISIARKPVVA

SEQ ID NO: 623 - protein, 231 aa, Acropora pulchra
MSYSKQGIVQVMKTKYHMEGSVNGHEFTIEGVGTGNPYEGTQMSELVITKPAGKPLPFSFDILSTVFQYGNRCFTKYPEGMTDYFKQAFPDGMSYERSFLYEDGGVATASWNIRLERDCFIHKSIYHGVNFPADGPVMKKKTIGWDKAFEKMTVSKDVLRGDVTEFLMLEGGGYHSCQFHSTYKPEKPAALPPNHVVEHHIVRTDLGQSAKGFTVKLEEHAAAHVNPLKVK

SEQ ID NO: 624 - protein, 231 aa, Actinia equina
MASLVTEDMCIKMTMEGTVNGHHFKCVGEGEGKPFEGTQVEKIRITEGGPLPFAYDILAPCCMYGSKTFIKHVSGIPDYFKESFPEGFTWERTQIFEDGGSLTIHQDTSLQGNNFIFKVNVIGANFPANGPVMQKKTAGWEPSVEILYPRDGVLCGQALMALKCTDGNHLTSHLRTTYRSRKPSNAVNMPEFHFGDHRIEILKAEQGKFYEQYESAVARYCEAAPSKLGHH

SEQ ID NO: 625 - protein, 232 aa, Anemonia sulcata
MASFLKKTMPFKTTIEGTVNGHYFKCTGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKAERWEPATEILYEVDGVLRGQSLMALKCPGGRHLTCHLHSTYRSKKPASALKMPGFHFGDHRIEIMEEVEKGKCYKQYEAAVARYCDAAPSKLGHH

SEQ ID NO: 626 - protein, 228 aa, Anemonia sulcata
MYPSIKETMRVQLSMEGSVNYHAFKCTGKGEGKPYEGTQSLNITITEGGPLPFAFDILSHAFQYGIKVFAKYPKEIPDFFKQSLPGGFSWERVSTYEDGGVLSATQETSLQGDCIICKVKVLGTNFPANGPVMQKKTCGWEPSTETVIPRDGGLLLRDTPALMLADGGHLSCFMETTYKSKKEVKLPELHFHHLRMEKLNISDDWKTVEQHESVVASYSQVPSKLGHN

SEQ ID NO: 627 - protein, 232 aa, Anemonia sulcata
MASFLKKTMPFKTTIEGTVNGHYFKCTGKGEGNPFEGTQEMKIEVIEGGPLPFAFHILSTSCMYGSKTFIKYVSGIPDYFKQSFPEGFTWERTTTYEDGGFLTAHQDTSLDGDCLVYKVKILGNNFPADGPVMQNKAGRWEPATEIVYEVDGVLRGQSLMALKCPGGRHLTCHLHTTYRSKKPASALKMPGFHFEDHRIEIMEEVEKGKCYKQYEAAVGRYCDAAPSKLGHN

SEQ ID NO: 628 - protein, 220 aa, Acropora tenuis
MRTKYHMEGSVNGHEFTIEGVGTGNPYEGTQTAELVIIKPVGKPLPFSFDILSSVFQYGNLCFTKYPADMTDYFKQAFPAGMSYERSFLFEDGAVATASWNIRLEGNCFIHNSIFHGVNFPADGPVMKKKTIGWDKSFQKMTVSKEVLRGDLAMFLLLEGGGYHRCQFHSTYKTERPVTLPPNHVVEHQIVRTDLGQSAKGFTVKLEEHAAAHVNPLKVK

SEQ ID NO: 629 - protein, 238 aa, Aequorea victoria
MSKGEELFTGVVPILVELDGDVNGHKFSVSGEGEGDATYGKLTLKFICTTGKLPVPWPTLVTTFSYAVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 630 - protein, 232 aa, Aequorea victoria
MNCGALLFKQKIPFIVELDGDVNGQVFSVRGNGFGDGSTGKIEIKFVCTTGEIPVAWESLVCSLAYGALVFTKYPSNINDFFKSTMPKGYIQERKITFENDGQYETRAEVTYENGALYNRVKLNGSGFRKDGNILGKKLDATSLGTCIYIMSNDQGNGLKGVYNKAYKVIGGNRQLASHQQTHTPIGDGLVSIPDYHVMHNHTSCSKDPTEPRDHLILKESVTAVDCQTAYM

SEQ ID NO: 631 - protein, 238 aa, Aequorea victoria
MSKGEELFTGVVPILVELDGDVNGHKFSVSGEGEGDATYGKLTLKFICTTGKLPVPWPTLVTTMSHGIQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 632 - protein, 239 aa, Aequorea victoria
MASKGEELFTGVVPILVELDGDVNGHKFSVSGEGEGDATYGKLTLKFICTTGKLPVPWPTLVTTLTHGVQCFSRYPDHMKQHDFFKSAMPEGYVQERTISFKDDGNYKTRAEVKFEGDTLVNRIELKGIDFKEDGNILGHKLEYNYNSGNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 633 - protein, 231 aa, Discosoma sp.
EEDNMAIIKEFMRFKVHMEGSVNGHEFEIEGEGEGRPYEGTQTAKLKVTKGGPLPFAWDILSPQFLYGSRAYVKHPADIPDYWKLSFPEGFKWERVMNFEDGGVVTVTQDSSLQDGEFIYKVKLRGTNFPSDGPVMQKKTMGWEAISERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 634 - protein, 111 aa, Arabidopsis thaliana
MIEKNYVITDPRLPDNPIIFASDGFLELTGYSREEILGRNARFLQGPETDQATVQKIRDAIRDQRETTVQLINYTKSGRKFWNLLHLQPVRDQKGELQYFIGVQLDGSDRV

SEQ ID NO: 635 - protein, 245 aa, Aequorea victoria
SSLENVYIMADKQKNGIKANFKIRHNIEDGGVQLAYHYQQNTPIGDGPVLLPDNHYLSTQSKLSKDPNEKRDHMVLLEFVTAAGITLGMDELYKGGTGGSMVSKGEELFTGVVPILVELDGDVNGHKFSVSGEGEGDATYGKLTLKFICTTGKLPVPWPTLVTTLGYGVQCFSRYPDHMKQHDFFKSAMPEGYIQERTIFFKDDGNYKTRAEVKFEGDTLVNRIELKGIDFKEDGNILGHKLEYN

SEQ ID NO: 636 - protein, 238 aa, Aequorea victoria
MSKGEELFTGVVPILVELDGDVNGHKFSVSGEGEGDATYGKLTLKFICTTGKLPVPWPTLVTTFSWGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 637 - protein, 238 aa, Aequorea victoria
MSKGEELFTGVVPILVELQGDVNGHKFSVSGEGEGDATYGKLTLKFICTTGKLPVPWPTLVTTFAWGVQCFARYPDHMKQHDFFKSVMPEGYVQERTIFFKDDGNYKTRAEVKFEGDTLVNRIELKGIDFKEDGNILGHKLEYNYISHNVYITADKQKNGIKANFKIRHNIVDGSVQLADHYQQNTPIGDGPVNLPDNHYLSTQSALSKDPNEKRDHMVLLEFVTAAGITHGMDELYK

SEQ ID NO: 638 - protein, 227 aa, Condylactis gigantea
MAGLLKESMRIKIYMEGTVNGYHFKCEGEGDGNPFEGTQNMRIRVTEGAPLPFAFDILSPCCAYGSKTFIKHTSGIPDYFKQSFPEGFTWERTTIYEDGGVLTAHQDTSLEGNCLIYKVKVLGTNFPADGPVMKKISGGWEPCTEIVYQDNGVLRGRNVMALKVSGRPPLICHLHSTYRSKKACALTMPGFHFADLRIQMPKKKKDEYFELYEASVARYSDVPEKAT

SEQ ID NO: 639 - protein, 229 aa, Condylactis gigantea
  MISC_FEATURE (95)...(95): Xaa is any amino acid
  MISC_FEATURE (97)...(97): Xaa is any amino acid
  MISC_FEATURE (98)...(98): Xaa is any amino acid
MYPWIKETMRSKVYMEGDVNNHAFKCTAVGEGKPYKGSQDLTITVTEGGPLPFAFDILSHAFQYGNKVFTDYPDDIPDFFKQSLSDGFTWRRVSXYXXGGVLTVTQDTSLKGDCIICNIKVHGTNFPENGPVMQNKTDGWEPSSTETVIPQDGGIVAARSPALRLRDKGHLICHMETTYKPNKEVKLPELHFHHLRMEKLSVSDDGKTIKQHEYVVASYSKVPSKIGRQ

SEQ ID NO: 640 - protein, 232 aa, Clytia hemisphaerica
MASAGALLLNQRVPFIMELDAEVNGIRFAVRGKGTGDATTGIIDTKFVCTTGKLPVPWASISSTMAYGALCFAKYPDSVKDFFKSAMPDGYIQEKTISFENDGAYKVRGVITYEHGSIYNRVTLKGEGFKKDGLILQKQYEFCCPNSAVYVLPDKENNGLRVVYNTIYKLKDGGHHLAAHEQQNTPLGGGVVDIPNYHHIHAGSIFSKDLEETRDHMCLVETVRAVNLETYN

SEQ ID NO: 641 - protein, 237 aa, Clytia hemisphaerica
MSSTALTEGGKLFEKEIPYITELEGDVEGMKFTIKGEGTGDGTTGLIKSKYICTTGDLPVPWATILSSISYGVFCFAKYPRHIADFFKSTQPDGYSQDRIISFDDDGQYDVKAKITYEDGTLYNRVVLDGTGFKSNGNILGMRVLYHSPPHIIYILPDRKNGGMKIEYNKAFDVMGGGHQMTRHAQFNKPLGAWEEDYPMYHHLSVWTSFGKDPEDDETDHLTIVEVIKAIDLDTYK

SEQ ID NO: 642 - protein, 233 aa, Clytia hemisphaerica
MDMANMNVGAMLFNKELPFVCELDGEINGHKFSVRGKGIGNSAQGLTHGIHVCTSGELPVSWTAITHNLQYGLLCFSQYPHDINDYIKSTFPEGYTKERTSNFDGDGKYTSRHVITYENGCIYNRVTINGSGFSDDGNVLGKNLADYEKPVCSMYFPGKDGLRAEICKLTETKDGGYQSCRLEDQVIRPISQGPTVPMTHHYNYSSVEYSKDANETRDHIVMKEITKVSHFIQ

SEQ ID NO: 643 - protein, 233 aa, Clytia hemisphaerica
MDMSSFNVGALIFNKELPFVVEVDFDIDDHKFSIRGKGVGNAEKGLMVGKYVVSEGELPCSWSAITHNFQYGQVCFTRYPKDIPDHIKSLFPEGYVQTRHSHFVDDGEYTSVHTLTYENGVIYNRVKVNGGGFKPDGNVFGKRLREVEPDICSVYFPGKDGYNCEFVKLSETVDGDYQAIRIDQVIRPLSDGPSLPMTKLYHHYKFEYSKDANETREHIIMKEQVHASHHTSK

SEQ ID NO: 644 - protein, 239 aa, Aequorea victoria
MVSKGEELFTGVVPILVELDGDVNGHKFSVSGEGEGDATYGKLTLKFICTTGKLPVPWPTLVTTFGYGVTCFARYPDHMRQHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSYQSALSKDPNEKRDHMVLLEFVTAAGITLGMDELYK

SEQ ID NO: 645 - protein, 239 aa, Aequorea victoria
MVSKGEELFTGVVPILVELDGDVNGHKFSVRGEGEGDATNGKLTLKFICTTGKLPVPWPTLVTTFGYGVACFSRYPDHMKQHDFFKSAMPEGYVQERTISFKDDGTYKTRAEVKFEGDTLVNRIELKGIDFKEDGNILGHKLEYNFNSHYVYITADKQKNGIKANFKIRHNVEDGSVQLADHYQQNTPIGDGPVLLPDNHYLSHQSALSKDPNEKRDHMVLLEFVTAAGITHGMDELYK

SEQ ID NO: 646 - protein, 227 aa, Condylactis passiflora
MAGLLKESMRIKIYMEGTVNGYHFKCEGEGDGNPYEGTQNMRIRVTEGAPLPFAFDILSPCCAYGSKTFIKHTSGIPDYFKQSFPEGFTWERTTIYEDGGVLTAHQDTSLEGNCLNYKVKVLGTNFPADGPVMKNISGGWEPCTEIVYQDNGVLRGRNVMALKVSGRPPLICHLHSTYRSKKACALTMPGFHFADLRIQMPKKKKDEYFELYEASVARYSDLPEKAN

SEQ ID NO: 647 - protein, 235 aa, Entacmaea quadricolor
GHLICNLKTTYRSKKPAKNLKMPGVYYVDRRLERIKEADKETYVEQHEVAVARYCDLPSKLGHAGGTGGSMSELITENMHMKLYMEGTVNNHHFKCTSEGEGKPYEGTQTMRIKVVEGGPLPFAFDILATSFMYGSKTFINHTQGIPDFFKQSFPEGFTWERVTTYEDGGVLTATQDTSLQDGCLIYNVKIRGVNFPSNGPVMQKKTLGWEASTEMLYPADGGLEGRSDMALKLV

SEQ ID NO: 648 - protein, 237 aa, Clavularia sp.
MVSKGEETIMSVIKPDMKIKLRMEGNVNGHAFVIEGEGSGKPFEGIQTIDLEVKEGAPLPFAYDILTTAFHYGNRVFTKYPEDIPDYFKQSFPEGYSWERSMTYEDGGICIATNDITMEEDSFINKIHFKGVNFPPNGPVMQKRTVGWEASTEKMYVRDGVLKGDVKMKLLLKGGGHYRCDFRTTYKVKQKAVKLPDYHFVDHRIEILSHDKDYNKVKLYEHAVAHSGLPGMDELYK

SEQ ID NO: 649 - protein, 239 aa, Aequorea victoria
MVSKGEELFTGVVPILVELDGDVNGHKFSVRGEGEGDATNGKLTLKFICTTGKLPVPWPTLVTTFGYGVACFSRYPDHMKQHDFFKSAMPEGYVQERTISFKDDGTYKTRAEVKFEGDTLVNRIELKGIDFKEDGNILGHKLEYNFNSHYVYITADKQKNSIKANFKIRHNVEDGSVQLADHYQQNTPIGDGPVLLPDNHYLSHQSALSKDPNEKRDHMVLLEFVTAAGITHGMDELYK

SEQ ID NO: 650 - protein, 239 aa, Aequorea victoria
MVSKGEELFTGVVPILVELDGDVNGHKFSVRGEGEGDATNGKLTLKFICTTGKLPVPWPTLVTTFGYGVACFSRYPDHMKQHDFFKSAMPEGYVQERTISFKDDGTYKTRAEVKFEGDTLVNRIELKGIDFKEDGNILGHKLEYNFNSHYVYITADKQKNSIKANFKIRHNVEDGSVQLADHYQQNTPIGDGPVLLPDNHYLSHQSKLSKDPNEKRDHMVLLEFVTAAGITHGMDELYK

SEQ ID NO: 651 - protein, 232 aa, Olindias formosus
MASGRALFQYPMTSKIELNGEINGKKFKVAGEGFTPNSGRFNMHAYCTTGDLPMSWVVIASPLQYGFHMFAHYPEDITHFFQECFPGSYTLDRTLRMEGDGTLTTHHEYSLKDGCVTSKTTLNASGFDPKGATMTKSFVEQLPNQVEIFAEGNGIRLLSHVPYLKKDGTIQIGYQDCIVKPVGGKKVTQPKYHFLHTQIIQKKDPNDTRDHIVQTELAVAGNPWHEPSASAV

SEQ ID NO: 652 - protein, 231 aa, Danafungia horrida
MSYSKQGIVQEMKTKYRMEGSVNGHEFTIEGVGTGYPYEGKQMSELVIIKPKGKPLPFSFDILSSVFQYGNRCFTKYPADMPDYFKQAFPDGMSYERSFLFEDGAVATASWNIRLEGNCFIHNSIFHGVNFPADGPVMKKKTIGWDKSFEKMTVSKEVLTGDVTMFLMLEGGGYHRCQFHSTYKTEKPVELPPNHVVEHQIVRTDLGQSAKGFTVKLEAHAAAHVNPLKVQ

SEQ ID NO: 653 - protein, 221 aa, Danafungia horrida
MALSKQAIGKDMKINYFMDGSVNGHEFTVKGEGIGKPYEGHHEMTLRVTMAKGGPLPFSFDLLSHTFCYGNRPFTKYPEEIPDYFKQAFPEGLSWERSLQFEDGGFAAVNANISLKGDCFEHNSKFVGVNFPAEGPVMQNKSLDWEPSTEKITVSDGVLKGDVPMFLKLVGGGNHKCQFTTTYKAAKKVLDMPQSHFIFHRLVRKTEGNITKLVEDVEAHN

SEQ ID NO: 654 - protein, 226 aa, Discosoma sp.
MVASSEDVIKEFMRFKVRMEGSVNGHEFEIEGEGEGRPYEGTQTAKLKVTKGGPLPFAWDILSPQFQYGSKVYVKHPADIPDYKKLSFPEGFKWERVMNFEDGGVVTVTQDSSLQDGCFIYKVKFRGVNFPSDGPVMQKKTMGWEASTERLYPRDGVLKGEIHQALKLKDGGHYLVEFKTIYMAKKPVQLPGYYYVDTKLDITSHNEDYTIVEQYERAEGRHHLFL

SEQ ID NO: 655 - protein, 230 aa, Discosoma sp.
MSCSKNVIKEFMRFKVRMEGTVNGHEFEIKGEGEGRPYEGHCSVKLMVTKGGPLPFAFDILSPQFQYGSKVYVKHPADIPDYKKLSFPEGFKWERVMNFEDGGVVTVSQDSSLKDGCFIYEVKFIGVNFPSDGPVMQRRTRGWEASSERLYPRDGVLKGDIHMALRLEGGGHYLVEFKSIYMVKKPSVQLPGYYYVDSKLDMTSHNEDYTVVEQYEKTQGRHHPFIKPLQ

SEQ ID NO: 656 - protein, 231 aa, Discosoma sp.
MSALKEEMKINLTMEGVVNGLPFKIRGDGKGKPYQGSQELTLTVVKGGPLPFSYDILTTMFQYGNRAFVNYPEDIPDIFKQTCSGPNGGYSWQRTMTYEDGGVCTATSNISVVGDTFNYDIHFMGANFPLDGPVMQKRTMKWEPSTEIMFERDGMLRGDIAMSLLLKGGGHYRCDFETIYKPNKVVKMPDYHFVDHCIEITSQQDYYNVVELTEVAEARYSSLEKIGKSKA

SEQ ID NO: 657 - protein, 243 aa, Zoanthus sp.
MVSKGEEHSKHGLKEEMTMKYHMEGCVNGHKFVITGEGIGYPFKGKQTINLCVIEGGPLPFSEDILSAGFKYGDRIFTEYPQDIVDYFKNSCPAGYTWGRSFLFEDGAVCRCNVDITVSEKENCIYHKSIFNGVNFPADGPVMKKMTTNWEASCEKIMPVPKQGILKGDVSMYLLLKDGGRYRCQFDTVYKAKSVPSKMPEWHFIQHKLLREDRSDAKNQKWQLTEHAIAFPSALAGMDELYK

SEQ ID NO: 658 - protein, 321 aa, Deinococcus radiodurans
MSRDPLPFFPPLYLGGPEITTENCEREPIHIPGSIQPHGALLTADGHSGEVLQMSLNAATFLGQEPTVLRGQTLAALLPEQWPALQAALPPGCPDALQYRATLDWPAAGHLSLTVHRVGELLILEFEPTEAWDSTGPHALRNAMFALESAPNLRALAEVATQTVRELTGFDRVMLYKFAPDATGEVIAEARREGLHAFLGHRFPASDIPAQARALYTRHLLRLTADTRAAAVPLDPVLNPQTNAPTPLGGAVLRATSPMHMQYLRNMGVGSSLSVSVVVGGQLWGLIACHHQTPYVLPPDLRTTLEYLGRLLSLQVQVKEA

SEQ ID NO: 659 - protein, 231 aa, Entacmaea quadricolor
MNSLIKENMRMMVVMEGSVNGYQFKCTGEGDGNPYMGTQTMRIKVVEGGPLPFAFDILATSFMYGSKTFIKHTKGIPDFFKQSFPEGFTWERVTRYEDGGVFTVMQDTSLEDGCLVYHAKVRGVNFPSNGAVMQKKTKGWEPSTEMLYPADGGLRGYSQMALNVDGGGYLFCSFETTYRSKKTDENFKMPGFHFVDHRLERLEESDKEMFVVQHEHAVAKFCDLPSKLGRL

SEQ ID NO: 660 - protein, 236 aa, Discosoma sp.
MSCSKNVIKEFMRFKVRMEGTVNGHEFEIEGEGEGRPYEGHNTVKLKVTKGGPLPFAWDILSPQFQYGSKVYVKHPADIPDYKKLSFPEGFKWERVMNFEDGGVVTVTQDPSLQDGCFIYKVKFIGVNFPSDGPVMQKKTMGWEASTERLYPRDGVLKGEIHKALKLKDGGHYLVEFKTIYMAKKPVQLPGYYYVDSKLDITSHNKDYTIVEQYERTEGRHHLFLKAELGSNVGER

SEQ ID NO: 661 - protein, 236 aa, Discosoma striata
MSCSKNVIKEFMRFKVRMEGTVNGHEFEIEGEGEGRPYEGHNTVKLKVTKGGPLPFAWDILSPQFQYGSKVYVKHPADIPDYKKLSFPEGFKWERVMNFEDGGVVTVTQDSSLQDGCFIYKVKFIGVNFPSDGPVMQKKTMGWEASTERLYPRDGVLKGEIHKALKLKDGGHYLVEFKTIYMAKKPVQLPGYYYVDSKLDITSHNKDYTIVEQYERTEGRHHLFLKAELGSNVGER

SEQ ID NO: 662 - protein, 226 aa, Euphyllia ancora
MSVVKPDMKIKLRMRGTVNGHNFVIEGEGNGKPYEGTQTIDLKVIEGAPLPFAYDILTPAFQYGNRAFTNYPADIPDYFKQTFPEGYSWERIMIYEDQGMCMATSHISLEGNCFFYDIRFHGVNFPPNGPVMQKKIQKSEPSTEKMYERDGMLKGDVNMALLLKGGGHYRCDFRSSYKAKKRVILPDYHYVDHRIEILSHEKDYSKVALHAIAKARYSLMPIAKTE

SEQ ID NO: 663 - protein, 225 aa, Scleractinia sp. Lizard Island 28
  MISC_FEATURE (76)...(76): Xaa is any amino acid
  MISC_FEATURE (103)...(103): Xaa is any amino acid
  MISC_FEATURE (133)...(133): Xaa is any amino acid
  MISC_FEATURE (136)...(136): Xaa is any amino acid
MNVIKTDMKMKLRMVGAVNGHKFEIAGEGKGKPFEGKQTMNLEVLVGGPLPFAFDILTTVFDYGNRVFVKYPKDIXBYFKQSFPEGFSWERSMAYEDGGICIXTNBITLMKGDCFLYEIRFDGVNFPANSPVXQKXTVKWEPSTEKLYVRDGVLKGDVNMALLLEEGGHYRCDFKTTYKSKKVVQLPDYHFVDHRIEIESHDKDYNKVKLCEHAEAHSGLPRQAK

SEQ ID NO: 664 - protein, 230 aa, Scleractinia sp. Lizard Island 28
MSAHIKPNMKIKLRMEGDVNGHPFVITGEGSGKPYEGTHAIDLKVKEGGPLPFAYDILTAAFQYGNRAFTKYPADIPDYFKQSFPDGYCWERSMVFEDQGICVVKSVISLDKKEPDCFNYDIRFYGVNFPATGPVMKKKTVKWEPSTQTMYERDGVLVGDVNMALLLEGGGHHRCDFKSTYRAKGVVLNMPGNHYVDHRIEIIHHDKGYNSVTVHESAEARHCSLPSKAK

SEQ ID NO: 665 - protein, 238 aa, Aequorea victoria
MSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLCTQSALSKDPNEKRDHMVLLEFVTAAGITHGMDELYK

SEQ ID NO: 666 - protein, 238 aa, Aequorea victoria
MSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQCALSKDPNEKRDHMVLLEFVTAAGITHGMDELYK

SEQ ID NO: 667 - protein, 228 aa, Aequorea victoria
MSKGEELFTGVVPILVELDGDVNGHRFSVSGEGEGDATYGKLTLKFICTTGKLPVPWPTLVTTLTWGVQCFSRYPDHMKQHDFFKSAMPEGYVQERTIFFKDDGNYKTRAEVKFEGDTLVNRIELKGIDFKEDGNILGHKLEYNYISHNVYITADKQKNGIKAHFKIRHNIEDGSVQLADHYQQNTPIGDGPVLLPDNHYLSTQSALSKDPNEKRDHMVLLEFVTAAG

SEQ ID NO: 668 - protein, 250 aa, Favites complanata
MSAIKPDMKIKLHMKGAVNGHIFEIDGEGNGKPFEGKQTIELKVVDGGPLPFAFDILTTVFEYGNRVFAKYPPEIVDYFKQSFPEGYSWERSMMYEDGGICIATNNITLLKDAHGVDYFYYNIRFDGVNFPTNGPVMQKKTVKWEPSTEKMYVRDGVLKGDVNMALLIEGGGHNRCDFKTTYKARKAVPLPNYHFVDHRIEIVSHDRDYNHVKLCEHAEAHSGLPSSRKARQISTERIRHEGYSPNIHLR

SEQ ID NO: 669 - protein, 262 aa, Favites complanata
MASFFVVISVLLCCASGNPVHSNYERTEESYFSPEESVISSVMNIKLRMEGEVNGHKFTVEGEGSGKPYEGTQTIDLEVTEGGPLPFAFDILTTAFQYGNRAFTKYPADIPDYFKESFPEGHSWVRTMVFDDGGVCDVTNDIRMYGNVFEYEITFHCNNFELSGPIMQKETLKWEPSCEGMYAGKNGVLLGDEFRHLLLVGGGHFRCDCSPSYSAKKRVEMPKYHFIDHRIEIVSHDKDYQKVKVYEIAEAKYSPLPESKAK

SEQ ID NO: 670 - protein, 225 aa, Discosoma sp.
MSCSKNVIKEFMRFKVRMEGTVNGHEFEIEGEGEGRPYGGHNTVKLKVTKGGPLPFAWDILSPQFQYGSKVYVKHPADIPDYKKLSFPEGFKWERVMNFEDGGVVTVTQDSSLQDGCFIYKVKFIGVNFPSDGPVMQKKTMGWEASTERLYPRDGVLKGDIHKALKLKDGGHYLVEFKSIYMAKKPVQLPGYYYVDSKLDITSHNEDYTIVEQYERTEGRHHLFL

SEQ ID NO: 671 - protein, 239 aa, Agaricia agaricites
  MISC_FEATURE (44)...(44): Xaa is any amino acid
MGRILILNPPSVNGIAEEMKTDLIMEGIVNGHSFTIEGKGTGYXYKGDQFMKLEVVKGAPLPFSFDILTTAFMYGNRVFTKYPSNIPDFFKQTFPEGYHWERIMPFEDQAVCTVTSHIRLEEKEEGEMRFVDNVKFHCVNFPPNGPVMQRKIMRWEPSTENMYPRNGLLEGYDEKTFRLKGGGYYQAEHKSIYEGKGSISMPDFHFIDHRIMITNHDEDYTNVELREVALARYSTLPPI

SEQ ID NO: 672 - protein, 259 aa, Agaricia fragilis
MAISTLKNVIIIVIIYSCSTCAVWSNSNSESSFTNGIAEEMKTRVHLEGTVNGHSFTIKGEGRGYPYKGEQFMSLEVVNGAPLPFSFDILTPAFMYGNRVFTKYPPNIPDYFKQTFPEGYHWERNIPFEDQAACTVTSHIRLEEEERRFVNNVRFHCVNFPPNGPVMQRRILKWEPSTENIYPRDGFLEGHVDMTLRVEGGGYYRAEFKSTYKGKTPVRDMPDFHFIDHRIEITEHDEDYTNVELHDVSWARYSMLPTM

SEQ ID NO: 673 - protein, 227 aa, Condylactis gigantea
MAGLLKESMRIKIYMEGTVNGYHFKCEGEGDGNPFEGTQNMRIRVTEGAPLPFAFDILSPCCAYGSKTFIKHTSGIPDYFKRSFPEGFTWEGTTIYEDGRVLTAHQDTSLEGNCPIYKVKVLGTNFPAASPVMKKVSGGWEPSTEIVYQDNGVLRGRNVMALKVSGRPPLICHLHSTYRSKKACALTMPGFHFADLRIQMPKKKKDEYFELYEASVARYSDVPEKAT

SEQ ID NO: 674 - protein, 234 aa, Montastraea cavernosa
  MISC_FEATURE (158)...(158): Xaa is any amino acid
  MISC_FEATURE (181)...(181): Xaa is any amino acid
  MISC_FEATURE (183)...(183): Xaa is any amino acid
MTSVAQEKGVIKPDMKMKLRMEGAVNGHKFVIEGDGKGKPFDGTQTMDLTVIEGAPLPFAYAILTTVFDYGNRVFAKYPEDIADYFKQTFPEGYFWERSMTYEDQGICIATNDITMMKGVDDCFVYKIRFDGVNFPANGPVMQRKTLKWEPSTEKMYXRDGVLKGDVNMALLLEGGGHYRXDXKTTYRAKKVVQLPDYHFVDHRIEIVSHDKDYNKVKLYEHAEAHSGLPRQAK

SEQ ID NO: 675 - protein, 231 aa, Ricordea florida
  MISC_FEATURE (146)...(146): Xaa is any amino acid
  MISC_FEATURE (149)...(149): Xaa is any amino acid
MNALQEEMKIKLTMVGVVNGQSFKIDGKGKGKPYEGSQELTLKVVEGGPLLFSYDILTTIFQYGNRAFVNYPKDIPDIFKQTCSGLDGGYSWQRTMTYEDGGVCTATSNVSVVGDTFNYEIHFMGANFPPNGPVMQKRTVKWEPSXEIXFERDGLLRGDVPMSLLLKGGDHYRCDFKTIYKPNKKVKLPGYHFVDHCIEIKSQENDYNMVALFEDAVAHYSPLEKKSQAKA

SEQ ID NO: 676 - protein, 232 aa, Olindias formosus
MASGRALFQYPMTSKIELNGEINGKKFKVAGEGFTPSSGRFNMHAYCTTGDLPMSWVVIASPLQYGFHMFAHYPEDITHFFQECFPGSYTLDRTLRMEGDGTLTTHHEYSLEDGCVTSKTTLNASGFDPKGATMTKSFVKQLPNEVKITAEGNGIRLTSTVLYLKEDGTIQIGTQDCIVKPVGGRKVTQPKAHFLHTQIIQKKDPNDTRDHIVQTELAVAGNLWHEPSASAV

SEQ ID NO: 677 - protein, 451 aa, Aequorea victoria
MRGSHHHHHHGMASMTGGQQMGRDLYDDDDKDLATMVDSSRRKWNKTGHAVRAIGRLSSLENVYIMADKQKNGIKANFKIRHNIEDGGVQLAYHYQQNTPIGDGPVLLPDNHYLSTQSKLSKDPNEKRDHMVLLEFVTAAGITLGMDELYKGGTGGSMVSKGEELFTGVVPILVELDGDVNGHKFSVSGEGEGDATYGKLTLKFICTTGKLPVPWPTLVTTLGYGVQCFSRYPDHMKQHDFFKSAMPEGYIQERTIFFKDDGNYKTRAEVKFEGDTLVNRIELKGIDFKEDGNILGHKLEYNTRDQLTEEQIAEFKEAFSLFDKDGDGGITTKQLGTVMRSLGQNPTEAELQDMINEVGADGNGTIDFPQFLTMMARKMKDTDSEEEIREAFRVFGKDGNGYISAAQLRHVMTNLGEKLTDEEVDEMIREAGIDGDGQVNYEQFVQMMTAK

SEQ ID NO: 678 - protein, 221 aa, Goniopora djiboutiensis
MSVIAKQMTYKVYMSGTVNGHYFEVQGDGKGKPYEGEQTVKLTVTKGGPLPFAWDILSPQAQYGSIPFTKYPEDIPDYVKQSFPEGYTWERIMNFEDGAVCTVSNDSSIQGNCFIYNVKFSGLNFPPSGPVMQKKTQGWEPNTERLLARDGMLIGNNFMALKLEGGGHYLCEFKSTYKAKKPVKMPGYHFVDRKLDVTNHNQDYTSVEQCEISIARKPVVA

SEQ ID NO: 679 - protein, 221 aa, Galaxea fascicularis
MSVIAKQMTYKVYMSGTVNGHYFEVEGDGKGKPYEGEQTVKLTVTKGGPLPFAWDILSPQSQYGSIPFTKYPEDIPDYVKQSFPEGYTWERIMNFEDGAVCTVSNDSSIQGNCFIYHVKFSGLNFPPNGPVMQKKTQGWEPNTERLFARDGMLIGNNFMALKLEGGGHYLCEFKSTYKAKKPVKMPGYHYVDRKLDVTNHNKDYTSVEQCEISIARKSVVA

SEQ ID NO: 680 - protein, 238 aa, Aequorea victoria
MSKGAELFTGVVPILVELDGDVNGHKFSVSGEGEGDATYGKLTLKFICTTGKLPVPWPTLVTTFSYGVQCFSRYPDHMKAHDFFKSAMPEGYVQERTISFKDDGNYKTRAEVKFEGDTLVNRIALKGIDFKEAGNILGHKLEYNYNSHNVYITADKQKNGIKANFKIRHNIADGSVQLADHYQQNTPIGAGPVLLPDNHYLSTQSALSKDPNEKRDHMVLLEFVTAAGITHGMDEAYK

SEQ ID NO: 681 - protein, 239 aa, Aequorea victoria
MASKGEELFTGVVPILVELDGDVNGHKFSVSGEGEGDATYGKLTLKFICTTGKLPVPWPTLVTTFAAGVQCFSRYPDHMKQHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 682 - protein, 238 aa, Aequorea victoria
MSKGEALFTGVVPILVELDGDVNGHKFSVSGEGEGDATYGKLTLKFICTTGKLPVPWPTLVTTFSYGVQCFSRYPDHMKQHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGITHGMDELYK

SEQ ID NO: 683 - protein, 238 aa, Aequorea macrodactyla
MSKGEELFTGIVPVLIELDGDVHGHKFSVRGEGEGDADYGKLEIKFICTTGKLPVPWPTLVTTLGYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSTQTAISKDRNETRDHMVFLEFFSACGHTHGMDELYK

SEQ ID NO: 684 - protein, 238 aa, Aequorea macrodactyla
MSKGEELFTGIVPVLIELDGDVHGHKFSVRGEGEGDADYGKLEIKFICTTGKLPVPWPTLVTTLGYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSLQTAISKDRNETRDHMVFLEFFSACGHTHGMDELYK

SEQ ID NO: 685 - protein, 238 aa, Aequorea macrodactyla
MSKGEELFTGIVPVLIELDGDVHGHKFSVRGEGEGDADYGKLEIKFICTTGKLPVPWPTLVTTLGYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSFQTAISKDRNETRDHMVFLEFFSACGHTHGMDELYK

SEQ ID NO: 686 - protein, 238 aa, Aequorea macrodactyla
MSKGEELFTGIVPVLIELDGDVHGHKFSVRGEGEGDADYGKLEIKFICTTGKLPVPWPTLVTTLGYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSYQTAISKDRNETRDHMVFLEFFSACGHTHGMDELYK

SEQ ID NO: 687 - protein, 238 aa, Aequorea macrodactyla
MSKGEELFTGIVPVLIELDGDVHGHKFSVRGEGEGDADYGKLEIKFICTTGKLPVPWPTLVTTLAYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSTQTAISKDRNETRDHMVFLEFFSACGHTHGMDELYK

SEQ ID NO: 688 - protein, 238 aa, Aequorea macrodactyla
MSKGEELFTGIVPVLIELDGDVHGHKFSVRGEGEGDADYGKLEIKFICTTGKLPVPWPTLVTTLSYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSHQTAISKDRNETRDHMVLLEFFSACGHTHGMDELYK

SEQ ID NO: 689 - protein, 238 aa, Aequorea macrodactyla
MSKGEELFTGIVPVLIELDGDVHGHKFSVRGEGEGDADYGKLEIKFICTTGKLPVPWPTLVTTLGYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSHQTAISKDRNETRDHMVFLEFFSACGHTHGMDELYK

SEQ ID NO: 690 - protein, 238 aa, Aequorea macrodactyla
MSKGEELFTGIVPVLIELDGDVHGHKFSVRGEGEGDADYGKLEIKFICTTGKLPVPWPTLVTTLSYGILCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSTQTAISKDRNETRDHMVFLEFFSACGHTHGMDELYK

SEQ ID NO: 691 - protein, 238 aa, Aequorea macrodactyla
MSKGEELFTGIVPVLIELDGDVHGHKFSVRGEGEGDADYGKLEIKFICTTGKLPVPWPTLVTTLSYGILCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSCQTAISKDRNETRDHMVFLEFFSACGHTHGMDELYK

SEQ ID NO: 692 - protein, 238 aa, Aequorea macrodactyla
MSKGEELFTGIVPVLIELDGDVHGHKFSVRGEGEGDADYGKLEIKFICTTGKLPVPWPTLVTTLSYGIQCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSTQTAISKDRNETRDHMVFLEFFSACGHTHGMDELYK

SEQ ID NO: 693 - protein, 221 aa, Goniopora tenuidens
MSVIAKQMTYKVYMSGTVNGHYFEVQGDGKGKPYEGEQTVKLTVTKGGPLPFAWDILSPQSQYGSIPFTKYPEDIPDYVKQSFPEGYTWERIMNFEDGAVCTVSNDSSIQGNCFIYNVKFSGLNFPPNGPVMQKKTQGWEPNTERLFARDGMLIGNNFMALKLEGGGHYLCEFKSTYKAKKPVKMPGYHYVDRKLDVTNHNIDYTSVEQCEISIARKPVVA

SEQ ID NO: 694 - protein, 227 aa, Heteractis crispa
MAGLLKESMRIKMYMEGTVNGHYFKCEGEGDGNPFTGTQSMRIHVTEGAPLPFAFDILAPCCEYGSRTFVHHTAEIPDFFKQSFPEGFTWERTTTYEDGGILTAHQDTSLEGNCLIYKVKVLGTNFPADGPVMKNKSGGWEPCTEVVYPENGVLCGRNVMALKVGDRRLICHLYTSYRSKKAVRALTMPGFHFTDIRLQMPRKKKDEYFELYEASVARYSDLPEKAN

SEQ ID NO: 695 - protein, 225 aa, Heteractis crispa
MCSYIKETMQSKVYMEGKVNDHNFKCTAEGKGEPYKGSQSLTITVTEGGPLPFAFDILSHAFRYGNKVFAKYPKDHPDFFKQSLPEGFTWERVSNYEDGGVLTVKQETSLEGDCIICKIKAHGTNFPADGPVMQKRTNGWEPSTETVIPRGGGILMRDVPALKLLGNKGHLLCVMETTYKSKKKVNLPKPHFHHLRMEKDSVSDDEKTIEQHENVRASYFNDSGK

SEQ ID NO: 696 - protein, 238 aa, Herbaspirillum frisingense
MRKGEELFTGVVPILVELDGDVNGHKFSVSGEGEGDATYGKLTLKFICTTGKLPVPWPTLVTTFGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 697 - protein, 228 aa, Heteractis magnifica
MYSYIKETMRSKVYMEGNVNNHAFKCTAEGEGKPYKGSQKLTITVTEGGPLPFAFDILSHAFQYGNKVFTKYPDDIPDFFKQSLSGGFTWKRVSNYEDGGVLTVDQKTSLEGDCIICNIKVHGTNFPADGPVMQKQTNGWEPSTETVIPRGEGILLRDVPALKLRNNKGHLLCVMETTYKPNKRVNLPKLHFHHLRMEKDSISDDEKTIKQHEDVRASYFNVRFDESS

SEQ ID NO: 698 - protein, 134 aa, Hydnophora rigida
MPRISDKLMKTRWRGFHSIPSIPPDLGGIYGIGEKTSRRKTTEHLYTGRAKDIKSRLMKHKYGHQAIDRKIRSNIKQKKLSDLRFKFVEERNHKAKEGLAIEGLKKKLGYAPRFNLRKGDGLRPRKSQDHKKKG

SEQ ID NO: 699 - protein, 134 aa, Hydnophora rigida
MPRISDKLMKTRWRGFHSIPSIPPDLGGIYGIGEKTSRRKTTEHLYTGRAKDIKSRLMKHKYGHQAIDRKIRSNIKQKKLSDLRFKFVEERNHKAKEGLAIEGLKKKLGYAPRFNLRKRGWIKAKEKPRPQKEG

SEQ ID NO: 700 - protein, 125 aa, Artificial Sequence
  Synthetic Construct
MIEKNFVITDPRLPDNPIIFASDGFLELTEYSREEILGRNARFLQGPETDQATVQKIRDAIRDQRETTVQLINYTKSGKKFWNLLHLQPVRDQKGELQYFIGVQLDGSDHVSGGGGSDYKDDDDK

SEQ ID NO: 701 - protein, 223 aa, Verrillofungia concinna
MSVIKPEMKMRYYMDGSVNGHEFTVEGEGTGRPYEGKLKITLDVTKGGPLPFAFDLLSTVFSYGNRALTKYPDDIPDYFKQCFPGGYSWERKFEFEDGGLAIAKAEISLKGNCFEHKSTIEGTFPDSSPIMQNKTLGWEPSTEKMTVRDGSMKGDDAAYLKLVGGGNHKCYFTTTYTAKKKIPNLPKSHFIGHRISSVVEGTKIKVMEDAIAHLYPFNGSPCQ

SEQ ID NO: 702 - protein, 224 aa, Verrillofungia concinna
DPTMVSVIKPEMKMRYYMDGSVNGHEFTVEGEGTGRPYEGKQKITLDVTKGGPLPFAFDLLSTVFSYGNRALTKYPDDIPDYFKQCFPGGYSWERKFEFEDGGLAIAKAEISLKGNCFEHKSTIEGTFPDSSPIMQNKTLGWEPSTEKMTVRDGSMKGDDAAYLKLVGGGNHKCYFTTTYTAKKKIPNLPGSHFIGHRISSVVEGTKIKVMEDAIAHLYPFNGS

SEQ ID NO: 703 - protein, 224 aa, Verrillofungia concinna
DPTMVSVIKPEMKMRYYMDGSVNGHEFTVEGEGTGRPYEGKHKITLDVTKGGPLPFAFDLLSTVFSYGNRALTKYPDDIPDYFKQCFPGGYSWERKFEFEDGGLAIAKAEISLKGNCFEHKSTIEGTFPDSSPIMQNKTLGWEPSTEKMTVRDGSMKGDDASYLKLVGGGNHKCYFTTTYTAKKKIPNLPGSHFIGHRISSVVEGTKIKVMEDAIAHLYPFNGS

SEQ ID NO: 704 - protein, 224 aa, Verrillofungia concinna
DPTMVSVIKPEMKMRYYMDGSVNGHEFTVEGEGTGRPYEGKLKITLDVTKGGPLPFAFDLLSTVFSYGNRALTKYPDDIPDYFKQCFPGGYSWERKFEFEDGGLAIAKAEISLKGNCFEHKSTIEGTFPDSSPIMQNKTLGWEPSTEKMTVRDGSMKGDDASYLKLVGGGNHKCYFTTTYTAKKKIPNLPGSHFIGHRISSVVEGTKIKVMEDAIAHLYPFNGS

SEQ ID NO: 705 - protein, 227 aa, Favia favus
MSVITSEMKMELRMEGAVNGHKFVITGKGSGQPFEGIQNMDLTVIEGGPLPFAFDILTTVFDYGNRVFVKYPEEIVDYFKQSFPEGYSWERSMSYEDGGICLATNNITMKKDGSNCFVYEIRFDGVNFPANGPVMQRKTVKWEPSTEKMYVRDGVLKGDVNMALLLQGGGHYRCDFRTTYKAKKVVQLPDYHFVDHRIEITSHDKDYNKVKLYEHAKAHSGLPRLAK

SEQ ID NO: 706 - protein, 145 aa, Pseudomonas putida
MSPMINAKLLQLMVEYSNDGIVVAEPEGNESILIYVNPAFERLTGYCADDILYQDGRFLQGEDHDQPGIAIIREAIREGRPCCQVLRNYRKDGSLFWNELSITPVHNEADRLTYFIGTQRDVTAQVFAEERMRELEAEVAELRRQ

SEQ ID NO: 707 - protein, 222 aa, Labidocera aestiva
MPVMKIECRISGTMNGEEFELVGAGDGNTDEGRMTNKMKSTKGPLSFSPYLLSHIMGYGFYHYATFPAGYENVYLHAAKNGGYTNTRTERYEDGGIISVNFTYRYEGNKVIGDFKVVGSGFPANSVIFTDKIIKSNPTCEHIYPKGDNILVNAYTRTWMLRDGGYYSAQVNNHLHFKTAMHPTMLQNGGSMFTYRKVEELHSQSDVGIVEYQHVFKTPTAFA

SEQ ID NO: 708 - protein, 228 aa, Branchiostoma lanceolatum
MHHHHHHGSLLPATHELHIFGSINSLEFDLVGRGTGNPKEGYEELHLKSTKSALQFSPWILVPQIGYGFYQYLPFPDGAMSPFQAAMNDGSGYQVHRTMQFEDGATLTGIYRYTYEGTHIKGEFQVIGTGFPADGPVMTNSLTAADWCVTKIVYPNENTIIDKFDWTYTTTSGKRYQSNVRSNFTFAKPIAANILQKQPMFVFRKTELKHSKTELNFKEWQTAFSDVM

SEQ ID NO: 709 - protein, 230 aa, Montastraea cavernosa
MSVIKSDMKIKLRMEGTVNGHKFVIEGEGEGKPYEGTQTMNLKVKEGAPLPFAYDILTTVFHYGNRVFAKYPKHIPDYFKQSFPEGYSWERSMTFEDGGICTARNDITLEGDCFFNEIRFDGVNFPPNGPVMQKKTLKWEPSTEKMYVRDGVLTGDINMALLLEGGGHYRCDFKTTYKAKKGVQLPDYHFVDHCIEILSHDKDYNNVKLYEHAVAHSGLPRQAKHHHHHH

SEQ ID NO: 710 - protein, 225 aa, Montastraea cavernosa
MSVIKSVMKIKLRMEGSVNGHNFVIVGEGEGKPYEGTQSMDLTVKEGAPLPFAYDIMTTVFHYGNRVFAKYPKHIPDYFKQMFPEGYSWERSMNFEDGGICTARNEITMEGDCFFNKVRFDGVNFPPNGPVMQKKTLKWEPSTEKMYVRDGVLTGDINMALLLEGGGHYRCDFRTTYRAKKKGVKLPDYHFVDHSIEILRHDKEYTEVKLYEHAEAHSGLPRVAK

SEQ ID NO: 711 - protein, 227 aa, Montastraea cavernosa
MSVIKPDMKIKLRMEGAVNGHKFVIEGDGKGKPFEGTQSMDLTVKEGAPLPFAYDILTTVFDYGNRVFAKYPQDIPDYFKQTFPEGYSWERSMTYEDQGICVATNDITLMKGVDDCFVYKIRFDGVNFPANGPVMQKKTLKWEPSTEKMYVRDGVLKGDVNMALLLEGGGHYRCDFKTTYKAKKFVQLPDYHFVDHRIEILSHDKDYNKVKLYEHAEAHSGLPRQAK

SEQ ID NO: 712 - protein, 234 aa, Montastraea cavernosa
MTSVAQEKGVIKPDMKMKLRMEGAVNGHKFVIEGDGKGKPFDGTQTMDLTVIEGAPLPFAYDILTTVFDYGNRVFAKYPEDIADYFKQTFPEGYFWERSMTYEDQGICIATNDITMMKGVDDCFVYKIRFDGVNFPANGPVMQRKTLKWEPSTEIMYVRDGVLKGDVNMALLLEGGGHYRCDFKTTYKAKKVVRLPDYHFVDHRIEIVSHDKDYNKVKLHEHAEARHGLSRKAK

SEQ ID NO: 713 - protein, 227 aa, Montastraea cavernosa
MSVIKPDMKIKLRMEGAVNGHKFVIEGDGKGKPFEGKQTMDLTVIEGAPLPFAYDILTTVFDYGNRVFAKYPKDIPDYFKQTFPEGYSWERSMTYEDQGICIATNDITMMKGVDDCFLYKIRFDGVNFPANGPVMQRKTLKWEPSTEKMYVRDGVLKGDVNMALLLEGGGHYRCDFKTTYKAKKVVQLPDYHFVDHRIEIVSHDKDYNKVKLYEHAEAHSGLPRQAK

SEQ ID NO: 714 - protein, 225 aa, Montastraea cavernosa
MSVIKSVMKIKLHMDGIVNGHKFMITGEGEGKPFEGTHTIILKVKEGGPLPFAYDILTTAFQYGNRVFTKYPKDIPDYFKQSFPEGYSWERSMTFEDQGVCTVTSDIKLEGDCFFYEIRFYGVNFPSSGPVMQKKTLKWEPSTENMYVRDGVLLGDVSRTLLLEGDKHHRCNFRSTYRAKKGVVLPEYHFVDHRIEILSHDKDYNTVEVYENAVARPSMLPSKAK

SEQ ID NO: 715 - protein, 225 aa, Montastraea cavernosa
MSVIKPDMKIKLRMEGAVNGHNFVIEGEGKGKPFEGTQTINLTVKEGGPLPFAYDILTAAFQYGNRAFTKYPRDIADYFKQSFPEGYSWERSMTYEDQGICIIKSDIRMEGDCFIYEIRYDGVNFPPSGPVMQKKTLKWEPSTEKMYVRDGVLKGDVNMALLLEGGGHYRCDFRSTYKAKKRVQLPDYHFVDHRIEILSHDNDYNTVKLSENAEARYSMLPSQAK

SEQ ID NO: 716 - protein, 227 aa, Montastraea cavernosa
MSVIKPDMKIKLRMEGAVNGHKFVIEGDGKGKPFEGKQTMDLTVIEGAPLPFAYDILTTVFDYGNRVFAKYPKDIPDYFKQTFPEGYSWERSMTYEDQGICIATNDITMMKGVDDCFVYKIRFDGVNFPANGPVMQRKTLKWEPSTEKMYVRDGVLKGDVNMALLLEGGGHYRCDFKTTYKAKKVVQLPDYHFVDHRIEIVSPDKDYNKVKLYEHAEAHFGLPRQAK

SEQ ID NO: 717 - protein, 227 aa, Montastraea cavernosa
MSVIKPDMKIKLRMEGAVNGHKFVIEGDGKGKPFEGKQTMDLTVIEGAPLPFAYDILTTVFDYGNRVFAKYPKDIPDYFKQTFPEGYSWERSMTYEDQGICIATNDITMMKGVDDCFVYKIRFDGVNFPANGPVMQRKTLKWEPSTEKMYVRDGVLKGDVNMALLLEGGGHYRCDSKTTYKAKKVVQLPDYHFVDHRIEIGSPDKDYNKVKLYEHAEAHFGLPRQAK

SEQ ID NO: 718 - protein, 225 aa, Montastraea cavernosa
MSVIKPDMKIKLRMEGAVNGHNFVIEGEGKGKPFEGTQTINLTVKEGGPLPFAYDILTAAFQYGNRAFTKYPRDIADYFKQSFPEGYSWERSMTYEDQGICIIKSDIRMEGDCFIYEIRYDGVNFPPSGPVMQKKTLKWEPSTEKMYVRDGVLKGEVNMALLLEGGGHYRCDFRSTYKAKKRVQLPDYHFVDHRIEILSHDNDYNTVKLSENAEARYSMLPRQAK

SEQ ID NO: 719 - protein, 225 aa, Montastraea cavernosa
MSVIKPIMEIKLRMQGVVNGHKFVIKGEGEGKPFEGTQTINLTVKEGAPLPFAYDILTSAFQYGNRVFTKYPDDIPDYFKQTFPEGYSWERIMAYEDQSICTATSDIKMEGDCFIYEIQFHGVNFPPNGPVMQKKTLKWEPSTEKMYVRDGVLKGDVNMALLLEGGGHYRCDFRSTYKAKKRVQLPDYHFVDHRIEILSHDNDYNTVKLSEDAEARYSMLPSQAK

SEQ ID NO: 720 - protein, 234 aa, Montastraea cavernosa
MTSVAQEKGVIKPDMKMKLRMEGAVNGHKFVVEGDGKGKPFDGTQTMDLTVIEGAPLPFAYDILTTVFDYGNRVFAKYPEDIADYFKQTFPEGYFWERSMTYEDQGICIATNDITMMEGVDDCFAYKIRFDGVNFPANGPVMQRKTLKWEPSTEIMYARDGVLKGDVNMALLLEGGGHYRCDFKTTYKAKKVVRLPDYHFVDHRIEIVSHDKDYNKVKLHEHAEARHGLSRKAK

SEQ ID NO: 721 - protein, 225 aa, Montastraea cavernosa
MSVIKSVMKIKLRMEGSVNGHNFVIVGEGEGKPYEGTQSMDLTVKEGAPLPFAYDIMTTVFHYGNRVFAKYPKHIPDYFKQMFPEEYSWERSMNFEGGGICTARNEITMEGDCFFNKVRFDGVNFPPNGPVMQKKTLKWEPSTEKMYVRDGVLTGDINMALLLEGGGHYRCDFRTTYRAKKKGVKLPDYHFEDHSIEILRHDKEYTEVKLYEHAEAHSGLPRVAK

SEQ ID NO: 722 - protein, 225 aa, Montastraea cavernosa
MSVIKSVMKIKLRMDGIVNGHKFMITGEGEGKPFEGTHTIILKVKEGGPLPFAYDILTTAFQYGNRVFTKYPKDIPDYFKQSFPEGYSWERSMTFEDQGVCTVTSDIKLEGDCFFYEIRFYGVNFPSSGPVMQKKTLKWEPSTENMYVRDGVLLGDVSRTLLLEGDKHHRCNFRSTYGAKKGVVLPEYHFVDHRIEILSHDKDYNTVEVYENAVARPSMLPVKAK

SEQ ID NO: 723 - protein, 225 aa, Montastraea cavernosa
MSVIKSVMKIKLRMDGIVNGHKFMITGEGEGKPFEGTHTIILKVKEGGPLPFAYDILTTAFQYGNRVFTKYPKDIPDYFKQSFPEGYSWERSMTFEDQGVCTVTSDIKLEGDCFFYEIRFYGVNFPSSGPVMQKKTLKWEPSTENMYVRDGVLLGDVSRTLLLEGNKHHRCNFRSTYRAKKGVVLPEYHFVDHRIEILSHDKDYNTVEVYENAVARPSMLPIKAK

SEQ ID NO: 724 - protein, 224 aa, Montastraea cavernosa
MSVIKSVMKIKLRMDGIVNGHKFMITGEGEGKPFEGTHTIILKVKEGGPLPFAYDILTTAFQYGNRVFTKYPKDIPDYFKQSFPEGYSWERSMTFEDQGVCTVTSDIKLEGDCFFYEIRFYGVNFPSSGPVMQKKTLKWEPSTENMYVRDGVLLGDVNMALLLEGGGHYRCDFKTTYKAKKVVQLPDYHFVDHRIEIVSHDKDYNKVKLYEHAEAHSGLPRQAK

SEQ ID NO: 725 - protein, 224 aa, Montastraea cavernosa
MSVIKPIMEIKLRMQGVVNGHKFVIKGEGEGKPFEGTQTINLTVKEGAPLPFAYDILTSAFQYGNRVFTKYPDDIPDYFKQTFPEGYSWERIMAYEDQSICTATSDIKMEGDCFIYEIQFHGVNFPPNGPVMQKKTLKWEPSTEKMYVRDGVLKGDVNMALLLEGGGHYRCDFKTTYKAKKVVRLPDYHFVDHRIEIVSHDKDYNKVKLYEHAEAHSGLPRQAK

SEQ ID NO: 726 - protein, 237 aa, Clavularia sp.
MVSKGEETTMSVIKPDMKIKLRMEGNVNGHAFVIEGEGSGKPFEGTQTIDLEVKEGAPLPFAYDILTTAFHYGNRVFTKYPDDIPDYFKQSFPEGYSWERSMTFEDGGICIATNDITMEKDSFINKIHFKGENFPPNGPVMQKKTVGWEASTEKMYVRDGVLKGDVKMKLLLKGGGHYRCDFRTTYKAKQKAVKLPDYHFVDHRIEILSHDKDYNKVKLYEHAVAHSGLPGMDELYK

SEQ ID NO: 727 - protein, 237 aa, Clavularia sp.
MVSKGEETIMSVIKPDMKIKLRMEGNVNGHAFVIEGEGRGRPFEGTQTIDLEVKEGAPLPFAYDILTTAFHYGNRVFTRYPDDIPDYFKQSFPEGYSWERSMTFEDGGICIATNDITIEKDSFINKIHFKGENFPPNGPVMQKKTVGWEASTEKMYVRDGVLKGDVKMKLQLKGGGHHRCDFRTTYKAKQKAVKLPDYHFVDHRIEILSHDKDYNKVKLYEHAVAHSGLPGMDELYK

SEQ ID NO: 728 - protein, 237 aa, Clavularia sp.
MVSKGEETIMSVIKPDMKIKLRMEGNVNGHAFVIEGEGSGKPFEGIQTIDLEVKEGAPLPFAYDILTTAFHYGNRVFTKYPEDIPDYFKQSFPEGYSWERSMTYEDGGICIATNDITMEEDSFINKIHFKGENFPPNGPVMQKRTVGWEASTEKMYVRDGVLKGDVKMKLLLKGGGHYRCDFRTTYKVKQKAVKLPDYHFVDHRIEILSHDKDYNKVKLYEHAVAHSGLPGMDELYK

SEQ ID NO: 729 - protein, 239 aa, Aequorea victoria
MVSKGEELFTGVVPILVELDGDVNGHKFSVRGEGEGDATNGKLTLKFICTTGKLPVPWPTLVTTFGYGVACFSRYPDHMKQHDFFKSAMPEGYVQERTISFKDDGTYKTRAEVKFEGDTLVNRIELKGIDFKEDGNILGHKLEYNFNSHYVYITADKQKNGIKANFKIRHNVEDGSVQLADHYQQNTPIGDGPVLLPDNHYLSHQSKLSKDPNEKRDHMVLLEFVTAAGITHGMDELYK

SEQ ID NO: 730 - protein, 225 aa, Montastraea cavernosa
MSVIKSVMKIKRRMEGSVNGHNFVIVGEGEGKPYEGTQSMDLTVKEGAPLPFAYDIMTTVFHYGNRVFAKYPKHIPDYFKQMFPEGYSWERSMNFEDGGICIARNEITMEGDCFFNKVRFDGVNFPPNGPVMQKKTLKWEPSTEKMYVRDGVLTGDINMALLLEGGGHYRCDFRTTYRAKKKGVKLPDYHFVDHSIEILRHDKEYTEVKLYEHAEAHSGLPRVAK

SEQ ID NO: 731 - protein, 221 aa, Montipora efflorescens
MSVIAKQMTYKVYMSGTVNGHYFEVEGDGKGKPYEGEQTVKLTVTKGGPLPFAWDILSPLSQYGSIPFTKYPEDIPDYVKQSFPEGYTWERIMNFEDGAVCTVSNDSSIQGNCFIYNVKISGVNFPPNGPVMQKKTQGWEPNTERLFARDGMLIGNNFMALKLEGGGYYLCEFKSTYKAKKPVRMPGYHYVDRKLDVTSHNKDYTFVEQCEISIARHSLLG

SEQ ID NO: 732 - protein, 225 aa, Scleractinia sp. Lizard Island 30
MSVIKQEMKIKLRMEGTVNGHSFVIEGEGKGKPYEGTQTINLTVKEGAPLPFAYDILTSGFQYGNRAFTKYPSDIPDYFKQTFPEGYSWERSMTYEDQGICTITSDIRMEDDCFMYEIRFKGENFSPNGPVMQKKTLKWEPSTEKMYVRDGVLKGDVNMALLLDGGGHYRCDFRSTYKAKKVVNLPDYHFVDHRIEILSHDKDYSKVKLYENAVARYSMLPSQAK

SEQ ID NO: 733 - protein, 227 aa, Orbicella faveolata
MSVIKPDMKIKLRMEGAVNGHKFVIEGDGKGKPFEGKQTMDLTVIEGAPLPFAYDILTTVFDYGNRVFAKYPKDIPDYFKQTFPEGYSWERSMTYEDQGICIATNDITMMKGVDDCFVYKIRFDGVNFPANGPVMQRKTLKWEPSTEKMYVRDGVLKGDVNMALLLEGGGHYRCDSKTTYKAKKVVQLPDYHFVDHRIEIVSHDKDYNKVKLYEHAEAHSGLPRQAK

SEQ ID NO: 734 - protein, 106 aa, Arabidopsis thaliana
MEKSFVITDPRLPDNPIIFASDSFLELTEYSREEILGRNPRFLRGPETDQATVQKIHDAIRDQREITVQLINYTKSGKKFWNLFRLQPIRDQKGELQYFIGVQLDG

SEQ ID NO: 735 - protein, 106 aa, Arabidopsis thaliana
MEKSFVITDPRLPDNPIIFASDGFLELTEYSREEILGRNGRFLQGPETDQATVQKIRDAIRDQREITVQLINYTKSGKKFWNLLHLQPMRDQKGELQYFIGVVLDG

SEQ ID NO: 736 - protein, 218 aa, Verrillofungia concinna
MVSVIKPEMKMRYYMDGSVNGHEFTIEGEGTGRPYEGHQEMTLRVTMAEGGPMPFAFDLVSHVFAYGHRVFTKYPEEIPDYFKQAFPEGLSWERSLEFEDGGSASVSAHISLRGNTFYHKSKFTGVNFPADGPIMQNQSVDWEPSTEKITASDGVLKGDVTMYLKLEGGGNHKCQFKTTYKAAKEILEMPGDHYIGHRLVRKTEGNITELVEDAVAHS

SEQ ID NO: 737 - protein, 218 aa, Verrillofungia concinna
MVSVIKPEMKMRYYMDGSVNGHEFTIEGEGTGRPYEGHQEMTLRVTMAEGGPMPFAFDLVSHVFCYGHRVFTKYPEEIPDYFKQAFPEGLSWERSLEFEDGGSASVSAHISLRGNTFYHKSKFTGVNFPADGPIMQNQSVDWEPSTEKITASDGVLKGDVTMYLKLEGGGNHKCQFKTTYKAAKEILEMPGDHYIGHRLVRKTEGNITELVEDAVAHS

SEQ ID NO: 738 - protein, 237 aa, Clavularia sp.
MVSKGEETIMSVIKPDMKIKLRMEGNVNGHAFVIEGEGSGKPFEGIQTIDLEVKEGAPLPFAYDILTTAFHYGNRVFTKYPEDIPDYFKQSFPEGYSWERSMTYEDGGICNATNDITMEEDSFINKIHFKGTNFPPNGPVMQKRTVGWEVSTEKMYVRDGVLKGDVKMKLLLKGGSHYRCDFRTTYKVKQKAVKLPDAHFVDHRIEILSHDKDYNKVKLYEHAVARNSTDSMDELYK

SEQ ID NO: 739 - protein, 214 aa, Meandrina meandrites
MAVPTQVKMKYSMDGNFNGQSFTVVGEGTGNPYEGHQSLKLTVKGEPLPFAFDILSATFTYGNRVFTKYPEGKTDYFKEAFPGGLTWERTMTFEDGGICTVAAEISLTGSVFEHKSKFVGVNFPANGPVIQKKTLGWETSTEKMAANDGSVQGYDTMFLKLEGGGRHKCYFVTNHKAKRAVKVPDNHFVWHRLVRNGDGNTVELEETAEARYDS

SEQ ID NO: 740 - protein, 236 aa, Discosoma sp.
MVSKGEENNMAIIKEFMRFKVRMEGSVNGHEFEIEGEGEGRPYEGTQTAKLKVTKGGPLPFAWDILSPQFTYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKMRLKLKDGGHYDAEVKTTYKAKKPVQLPGAYMVSIKLDITSHNEDYTIVEQYERAEGRHSTGGMDELYK

SEQ ID NO: 741 - protein, 236 aa, Discosoma sp.
MVSKGEENNMAIIKEFMRFKVRMEGSVNGHEFEIEGEGEGRPYEGTQTAKLKVTKGGPLPFAWDILSPQFTYGSKAYVKHPADIPDYLKLSFPEGFKWERVMNFEDGGVVTVTQDSSLQDGEFIYKVKLRGTNFPSDGPVMQKKTMGWEASSERMYPEDGALKGEIKMRLKLKDGGHYDAEVKTTYKAKKPVQLPGAYKVDIKLDITSHNEDYTIVEQYERAEGRHSTGGMDELYK

SEQ ID NO: 742 - protein, 182 aa, Scleractinia sp. Lizard Island 39
MNIKLRMEGEVNGHKFTVEGEGSGKPYEGTQTIDLEVTEGGPLPFAFDILTTAFQYGNRAFTKYPADIPDYFKESFPEGHSWVRTMVFDDGGVCDVTNDIRMYGNVFEYETTFHCNNFDPSGPVMQKETLKWEPSCEGMYAGKNGVLLGDEFRHLLLVGGGHFRCDFRSTYSARKRVEMPEY

SEQ ID NO: 743 - protein, 222 aa, Montipora sp. 20
MVSVIAKQMTYKVYMSGTVNGHYFEVEGDGKGKPYEGEQTVKLTVTKGGPLPFAWDILSPLSQYGSIPFTKYPEDIPDYVKQSFPEGYTWERIMNFEDGAVCTVSNDSSIQGNCFIYNVKISGVNFPPNGPVMQKKTQGWEPSTERLFARDGMLIGNDFMALKLEGGGHYLCEFKSTYKAKKPVRMPGYHYVDRKLDVTSHNRDYTSVEQCEISIARHSLLG

SEQ ID NO: 744 - protein, 227 aa, Lobophyllia hemprichii
MVSAIKPDMKIKLRMEGNVNGHHFVIDGDGTGKPFEGKQSMDLEVKEGGPLPFAFDILTTAFHYGNRVFAKYPDNIQDYFKQSFPKGYSWERSLTFEDGGIANARNDITMEGDTFYNKVRFYGTNFPANGPVMQKKTLKWEPSTEKMYVRDGVLTGDIEMALLLEGNAHYRADFRTTYKAKEKGVKLPGAHFVDHAIEILSHDKDYNKVKLYEHAVAHSGLPDNARR

SEQ ID NO: 745 - protein, 239 aa, Aequorea victoria
MVSKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKANFKIRHNIEDGSVQLADHYQQNTPIGDGPVLLPDNHYLSHQSKLSKDPNEKRDHMVLLEFVTAAGITLGMDELYK

SEQ ID NO: 746 - protein, 237 aa, Zoanthus sp.
MVSKGEGHSKHGLKEEMTVKYHMEGCVNGHKFVITGEGIGNPFKGKQTANLCVIEGGPLPFSEDILSPGFKYGDRIFTEYPQDIVDYFKNSCPAGYTWERSFLFEDGAVCRCNVDITVSEKENCIYHKSIFYGVNFPADGPVMKKMTTNWEASCEKIVPVPKQGILKGKVSMYLLLKDGGRYHCQFDTVYKAKSVPSKMPEWHFIQHKLLREDRSDAKNQKWQLTEHAIAGMDELYK

SEQ ID NO: 747 - protein, 237 aa, Zoanthus sp.
MVSKGEGQSKHGLKEEMTVKYHMEGCVNGHKFVITGEGIGNPFKGKQTANLCVIEGGPLPFSEDILSPGFKYGDRIFTEYPQDIVDYFKNSCPAGYTWERSFLFEDGAVCRCNVDITVSEKENCIYHKSIFRGVNFPADGPVMKKMTTNWEASTEKIVPVPKQGILKGKVKMYLLLKDGGRYHCQFDTVYKAKSVPSKMPEWHFIQHKLLREDRSDAKNQKWQLTEHAIAGMDELYK

SEQ ID NO: 748 - protein, 232 aa, Artificial Sequence
  Synthetic Construct
MVSKGEEVIKEFMQFKVHMEGSVNGHEFEIEGEGEGRPYEGTQTAKLKVTKGGPLPFAWDILSPQFMYGSKAYVKHPADIPDYFKLSFPEGFKWERVMNFEDGGAVTVTQDSSLEDGTLIYKVKFRGTNFPPDGPVMQKKTMGWEPSTERLYPQDGVLKGEISQALKLKDGGHYLVDFKTTYMAKKPVQLPGAYNVDTKLDITSHNEDYTVVEQYERSEGRHSTGGMDELYK

SEQ ID NO: 749 - protein, 232 aa, Artificial Sequence
  Synthetic Construct
MVSKGEEVIKEFMQFKVHMEGSVNGHEFEIEGEGEGRPYEGTQTAKLKVTKGGPLPFAWDILSPQFMYGSRAYVKHPADIPDYFKLSFPEGFKWERVMNFEDGGAVTVTQDSSLEDGTLIYKVKFRGTNFPPDGPVMQKKTMGWEPSTERLYPQDGVLKGEISQALKLKDGGHYLVDFKTTYMAKKPVQLPGAYNVDRKLDITSHNEDYTVVEQYERAEGRHSTGGMDELYK

SEQ ID NO: 750 - protein, 232 aa, Artificial Sequence
  Synthetic Construct
MVSKGEEVIKEFMQFKVHMEGSVNGHEFEIEGEGEGRPYEGTQTAKLKVTKGGPLPFAWDILSPQFMYGSRAYTKHPADIPDYFKLSFPEGFKWERVMNFEDGGAVTVTQDSSLEDGTLIYKVKFRGTNFPPDGPVMQKKTMGWEPSTERLYPQDGVLKGEISMALKLKDGGHYLVDFKTTYMAKKPVQLPGAYNVDRKLDITSHNEDYTVVEQYERAEGRHSTGGMDELYK

SEQ ID NO: 751 - protein, 232 aa, Artificial Sequence
  Synthetic Construct
MVSKGEAVIKEFMRFKVHMEGSMNGHEFEIEGEGEGRPYEGTQTAKLKVTKGGPLPFSWDILSPQFMYGSRAFTKHPADIPDYFKQSFPEGFKWERVMNFEDGGAVTVTQDTSLEDGTLIYKVKLRGTNFPPDGPVMQKKTMGWEASTERLYPEDGVLKGDIKMALRLKDGGRYLVDFKTTYKAKKPVQMPGAYNVDRELDITSHNEDYTVVEQYERSEGRHSTGGMDELYK

SEQ ID NO: 752 - protein, 221 aa, Clavularia sp.
MSGVIKPDMKIKLKMEGNVNGYAFVIEGEGEGKPYDGTNTINLEVKEGAPLPFSYDILTTAFAYGNRAFTKYPDDIPNYFKQSFPEGYSWERTMTFEDKGIVKVKSDISLEEDSFIYEIYLKGENFPPNGPVMQKKTTGWDASTERMYVRDGVLKGDVKHKLLLEGGGYYRVDFKTIYRAKKAVKLPDYHFVDHRIEILNYDKDYNKVTVYESAVARNSTD

SEQ ID NO: 753 - protein, 240 aa, Clavularia sp.
MVSKGEETTMGVIKPDMKIKLKMEGNVNGHAFVIEGEGEGKPYDGTNTVNLEVKEGAPLPFSYDILSNAFCYGNRAFTKYPDDIANYFKQSFPEGYSWERTMTFEDKGIVKVKSDISMEEDSFIYEIRLKGKNFPPNGPVMQKKTLKWEPSTEILYVRDGVLVGDIKHKLLLEGGGHYRVDFKTIYKAKKVVKLPDYHFVDHRIEILNHDKDYNKVTLYENAVARYSLLPPQAGMDELYK

SEQ ID NO: 754 - protein, 240 aa, Clavularia sp.
MVSKGEETTMGVIKPDMKIKLKMEGNVNGHAFVIEGEGEGKPYDGTNTVNLEVKEGAPLPFSYDILTNAFGYGNRAFTKYPDDIPNYFKQSFPEGYSWERTMTFEDKGIVKVKSDISMEEDSFIYEIRLKGENFPPNGPVMQKKTLKWEPSTEILYVRDGVLVGDIKHKLLLEGGGHYRVDFKTIYRAKKVVKLPDYHFVDHRIEILNHDKDYNKVTLYESAVARYSLLPPQAGMDELYK

SEQ ID NO: 755 - protein, 236 aa, Clavularia sp.
MVNKGEETTMGVIKPDMKIKLKMEGNVNGHAFVIEGEGEGKPYDGTNTVNLEVKEGAPLPFSYDILTNAFAYGNRAFTKYPDDIPNYFKQSFPEGYSWERTMTFEDKGIVKVKSDISMEEDSFIYEIRLKGENFPPNGPVMQKKTLKWEPSTEILYVRDGVLVGDIKHKLLLEGGGHYRVDFKTIYRAKKVVKLPDYHFVDHRIEILNHDKDYNKVTVYESAVARYSTGGMDELYK

SEQ ID NO: 756 - protein, 236 aa, Clavularia sp.
MVSKGEETTMGVIKPDMKIKLKMEGNVNGHAFVIEGEGEGKPYDGTNTINLEVKEGAPLPFSYDILTTAFAYGNRAFTKYPDDIPNYFKQSFPEGYSWERTMTFEDKGIVKVKSDISMEEDSFIYEIHLKGENFPPNGPVMQKKTLKWEPSTEILYVRDGVLVGDIKHKLLLEGGGHHRVDFKTIYRAKKAVKLPDYHFVDHRIEILNHDKDYNKVTVYESAVARYSTGGMDELYK

SEQ ID NO: 757 - protein, 236 aa, Clavularia sp.
MVSKGEETTMGVIKPDMKIKLKMEGNVNGHAFVIEGEGEGKPYDGTNTINLEVKEGAPLPFSYDILTTAFAYGNRAFTKYPDDIPNYFKQSFPEGYSWERTMTFEDKGIVKVKSDISMEEDSFIYEIHLKGENFPPNGPVMQKKTLGWDASTERMYVRDGVLVGDVKHKLLLEGGGHHRVDFKTIYRAKKAVKLPDYHFVDHRIEILNHDKDYNKVTVYESAVARYSTGGMDELYK

SEQ ID NO: 758 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYGSDNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 759 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYSSDNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 760 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYFSGNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 761 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYISDNVYITADKQKNGIKANFKIRHNIEDGGVQLADHYQQNTPIGDGPVLLPDNHYLSTQSKLSKDPNEKRDHMVLLEFRTAAGITLGMDELYK

SEQ ID NO: 762 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYISGNVYITADKQKNGIKANFKIRHNIEDGGVQLADHYQQNTPIGDGPVLLPDNHYLSTQSKLSKDPNEKRDHMVLLEFLTAAGITLGMDELYK

SEQ ID NO: 763 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYISGNVYITADKQKNGIKANFKIRHNIEDGGVQLADHYQQNTPIGDGPVLLPDNHYLSTQSKLSKDPNEKRDHMVLLEFVTAAGITLGMDELYK

SEQ ID NO: 764 - protein, 239 aa, Aequorea victoria
MVSKGEELFTGVVPILVELDGDVNGHKFSVSGEGEGDATYGKLTLKFICTTGKLPVPWPTLVTTLSWGVQCFARYPDHMKQHDFFKSAMPEGYVQERTIFFKDDGNYKTRAEVKFEGDTLVNRIELKGIDFKEDGNILGHKLEYNYISRNVYITADKQKNGIKANFKIRHNIEDGGVQLADHYQQNTPIGDGPVLLPDNHYLSTQSKLSKDPNEKRDHMVLLEFATAAGITLGMDELYK

SEQ ID NO: 765 - protein, 149 aa, Nostoc punctiforme
MANLDKVLNTTVTEVRQFLQVDRVFMYQFEPDYSGVVVVESVDDRWIAILNTQVQDTYFMETRGEEYSHGRIQAIADIYTAGLTECHRDLLTQFQVRANLAVPILQGKKLWGLLVANQLAAPRQWQTWEIDFLKQLAVQVGIAIQQSQL

SEQ ID NO: 766 - protein, 238 aa, Aequorea macrodactyla
MSKGEELFTGVVPILVELDGDVHGHKFSVRGEGEGDADYGKLEIKFICTTGKLPVPWPTLVTTLGYGILCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSYQTAISKDRNETRDHMVFLEFFSACGHTHGMDELYK

SEQ ID NO: 767 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKTRHNIEDGSVQLADHYQQNTPIGDGPVLLPDNHYLSTQSALSKDPNEKRDHMVLLEFVTAAGITHGMDELYK

SEQ ID NO: 768 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKVRHNIEDGSVQLADHYQQNTPIGDGPVLLPDNHYLSTQSALSKDPNEKRDHMVLLEFVTAAGITHGMDELYK

SEQ ID NO: 769 - protein, 222 aa, Pocillopora damicornis
MSLSKQVILKDMNLKFEMKGSVNGHYFEIEGEGRGKPYEGVQKSTFWVTKGGPLPFSFDILSSAFKYGNRCFTKYPADMPDYFKEAFPAGMSFERTFTFEDGGVATASGHICLEGNWFKHTSMFHGVNFPANGPIMQKRTIGWDPSFEKMTVSNNILRGDVTMFLQLKGGGYHSCQFHTSYKTKEPVTLPQNHVVEHRITRTDIEDKKVLLEETAVAHVNPL

SEQ ID NO: 770 - protein, 224 aa, Echinophyllia sp. SC22
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTENLYVRDGVLKGDVNMALSLEGGGHYRCDFKTTYKAKKVVQLPDYHFVDHHIEIKSHDKDYSNVNLHEHAEAHSELPRQAK

SEQ ID NO: 771 - protein, 238 aa, Aequorea victoria
MSKGEELFTGVVPILVELDGDVNGHKFSVSGEGEGDATYGKLTLKFICTTGKLPVPWPTLVTTLSYGVQCFSRYPDHMKQHDFFKSAMPEGYVQERTIFFKDDGNYKTRAEVKFEGDTLVNRIELKGIDFKDDGNILGHKLEYNYNEHLVYIMADKQKNGIKVIFQVHHNIEDGSVQLADHYQQNTPIGDGPVLLPDNHYLHTQSALSKDPNEKRDHMVFLEFVTAAGITHGMDELYK

SEQ ID NO: 772 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNDHQVYIMADKQKNGIKVNFKIRHNIEDGSVQLADHYQQNTPIGDGPVLLPDNHYLFTTSTLSKDPNEKRDHMVLLEFVTAAGITHGMDELYK

SEQ ID NO: 773 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKDDGNILGHKLEYNYNEHLVYIMADKQKNGIKVIFQVHHNIEDGSVQLADHYQQNTPIGDGPVLLPDNHYLHTQSALSKDPNEKRDHMVFLEFVTAAGITHGMDELYK

SEQ ID NO: 774 - protein, 221 aa, Psammocora superficialis
  MISC_FEATURE (41)...(41): Xaa is any amino acid
  MISC_FEATURE (53)...(53): Xaa is any amino acid
  MISC_FEATURE (206)...(206): Xaa is any amino acid
MSVIAKQMTYKVYMSGTVNGHYFEVEGDGKGKPYEGEQTVXLTVTKGGPLPFXWDILSPQTQYGSIPFTKYPEDIPDYVKQSFPEGYTWERIMNFEDGAVCTVSNDSSIQGNCFIYNVKISGLNFPPNGPVMQKKTQGWEPNTERLFARDGMLIGNNFMALKLEGGGHYLCEFKSTYKAKKPVRMPGYHYVDRKLDVTSHBKDYTXVEQCEISIARHSLLG

SEQ ID NO: 775 - protein, 238 aa, Ptilosarcus sp. CSG-2001
MNRNVLKNTGLKEIMSAKASVEGIVNNHVFSMEGFGKGNVLFGNQLMQIRVTKGGPLPFAFDIVSIAFQYGNRTFTKYPDDIADYFVQSFPAGFFYERNLRFEDGAIVDIRSDISLEDDKFHYKVEYRGNGFPSNGPVMQKAILGMEPSFEVVYMNSGVLVGEVDLVYKLESGNYYSCHMKTFYRSKGGVKEFPEYHFIHHRLEKTYVEEGSFVEQHETAIAQLTTIGKPLGSLHEWV

SEQ ID NO: 776 - protein, 238 aa, Aequorea victoria
MSKGEELFTGVVPILVELDGDVNGHKFSVSGEGEGDATYGKLTLKFICTTGKLPVPWPTLVTTFSYGVQCFSRYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 777 - protein, 442 aa, Entacmaea quadricolor
MGSHHHHHHGMASMTGGQQMGRDLYDDDDKDLATMVDSSRRKWNKTGHAVRAIGRLSSAINTEMMYPADGGLRGYTHMALKVDGGGHLSCSFVTTYRSKKTVGNIKMPGIHYVSHRLERLEESDNEMFVVQREHAVAKFVGLGGGGGTGGSMNSLIKENMRMKVVLEGSVNGHQFKCTGEGEGNPYMGTQTMRIKVIEGGPLPFAFDILATSFMYGSRTFIKYPKGIPDFFKQSFPEGFTWERVTRYEDGGVITVMQDTSLEDGCLVYHAQVRGVNFPSNGAVMQKKTKGWEPTRDQLTEEQIAEFKEAFSLFDKDGDGTITTKELGTVMRSLGQNPTEAELQDMINEVDADGDGTIDFPEFLIMMARKMKDTDSEEEIREAFRVFDKDGNGYISAAELRHVMTNLGEKLTDEEVDEMIREADIDGDGQVNYEEFVQMMTAK

SEQ ID NO: 778 - protein, 231 aa, Ricordea florida
MSALKEEMKIKLKMVGVVNGQSFQIDGEGKGKPYEGSQKLTLEVVEGGPLLFSYDILTTIFQYGNRAFVNYPKDIPDIFKQTCSGPDGGFSWQRTMTYEDGGVCTASNHISVDGDTFYYVIRFNGENFPPNGPVMQKRTVKWEPSTEIMFERDGLLRGDIAMSLLLKGGGHYRCDFKTIYTPKRKVNMPGYHFVDHCIEIQKHDKDYNMAVLSEDAVAHNSPLEKKSQAKA

SEQ ID NO: 779 - protein, 231 aa, Ricordea florida
  MISC_FEATURE (149)...(149): Xaa is any amino acid
MNALQEEMKIKLTMVGVVNGQSFKIDGKGKGKPYEGSQELTLKVVEGGPLLFSYDILTTIFQYGNRAFVNYPKDIPDIFKQTCSGLDGGYSWQRTMTYEDGGVCTATSNVSVVGDTFNYEIHFMGANFPPNGPVMQKRTVKWEPSTEIXFERDGLLRGDVPMSLLLKGGDHYRCDFKTIYKPNKKVKLPGYHFVDHCIEIKSQENDYNMVALFEDAVAHYSPLEKKSQAKA

SEQ ID NO: 780 - protein, 231 aa, Ricordea florida
  MISC_FEATURE (11)...(11): Xaa is any amino acid
MSALKEEMKIXLTLVGVVNGHPFKIIGDGKGKPYEGSQELTLAVVEGGPLPFSYDILTTIVHYGNRAFVNYPKDIPDIFKQTCSGPGAGYSWQRTMSFEDGGVCTATSHIRVDGDTFNYDIHFMGADFPLNGPVMQKRTVKWEPSTEIMFQCDGLLRGDVAMSLLLKGGGHYRCDFKTIYKPKKNVKMPGYHFVDHCIEITSQQDDYNVVELYEGAVAHYSPLQKPCQAKA

SEQ ID NO: 781 - protein, 231 aa, Entacmaea quadricolor
MNSLIKENMRMMVVMEGSVNGYQFKCTGEGDGNPYMGTQTMRIKVVEGGPLPFAFDILATSFMYGSKTFIKHTKGIPDFFKQSFPEGFTWERVTRYEDGGVFTVMQDTSLEDGCLVYHAKVTGVNFPSNGAVMQKKTKGWEPSTEMLYPADGGLRGYSQMALNVDGGGYLFCSFETTYRSKKTDENFKMPGFHFVDHRLERLEESDKEMFVVQHEHAVAKFCDLPSKLGRL

SEQ ID NO: 782 - protein, 238 aa, Aequorea victoria
MSKGEELFTGVVPILVELDGDVNGHKFSVSGEGEGDATYGKLTLKFISTTGKLPVPWPTLVTTLGYGVQCFSRYPDHMKRHDFFKSAMPEGYVQERTIFFKDDGNYKTRAEVKFEGDTLVNRIELKGIDFKEDGNILGHKLEYNYNCHNVYIMADKQKNGIKVNFKIRHNIEDGSVQLADHYQQNTPIGDGPVLLPDNHYLSTCSALSKDPNEKRDHMVLLEFVTAAGITHGMDELYK

SEQ ID NO: 783 - protein, 238 aa, Aequorea victoria
MSKGEELFTGVVPILVELDGDVNGHKFSVSGEGEGDATYGKLTLKFISTTGKLPVPWPTLVTTFSYGVQCFSRYPDHMKRHDFFKSAMPEGYVQERTIFFKDDGNYKTRAEVKFEGDTLVNRIELKGIDFKEDGNILGHKLEYNYNCHNVYIMADKQKNGIKVNFKIRHNIEDGSVQLADHYQQNTPIGDGPVLLPDNHYLKTCSALSKDPNEKRDHMVLLERVTAAGITHGMDELYK

SEQ ID NO: 784 - protein, 238 aa, Aequorea victoria
MSKGEELFTGVVPILVELDGDVNGHKFSVSGEGEGDATYGDLTLKFISTTGKLPVPWPTLVTTFSYGVQCFSRYPDHMKRHDFFKSAMPEGYVQERTIFFKDDGNYKTRAEVKFEGDTLVNRIELKGIDFKEDGNILGHKLEYNYNCHNVYIMADKQKNGIKVNFKIRHNIEDGSVQLADHYQQNTPIGDGPVLLPDNHYLSTCSALSKDPNEKRDHMVLLERVTAAGITHGMDELYK

SEQ ID NO: 785 - protein, 238 aa, Aequorea victoria
MSKGEELFTGVVPILVELDGDVNGHKFSVSGEGEGDATYGKLTLKFISTTGKLPVPWPTLVTTLTYGVQCFSRYPDHMKRHDFFKSAMPEGYVQERTIFFKDDGNYKTRAEVKFEGDTLVNRIELKGIDFKEDGNILGHKLEYNYNCHNVYIMADKQKNGIKVNFKIRHNIEDGSVQLADHYQQNTPIGDGPVLLPDNHYLSTCSALSKDPNEKRDHMVLLEFVTAAGITHGMDELYK

SEQ ID NO: 786 - protein, 315 aa, Rhodopseudomonas palustris
MVAGHASGSPAFGTADLSNCEREEIHLAGSIQPHGALLVVSEPDHRIIQASANAAEFLNLGSVLGVPLAEIDGDLLIKILPHLDPTAEGMPVAVRCRIGNPSTEYDGLMHRPPEGGLIIELERAGPPIDLSGTLAPALERIRTAGSLRALCDDTALLFQQCTGYDRVMVYRFDEQGHGEVFSERHVPGLESYFGNRYPSSDIPQMARRLYERQRVRVLVDVSYQPVPLEPRLSPLTGRDLDMSGCFLRSMSPIHLQYLKNMGVRATLVVSLVVGGKLWGLVACHHYLPRFIHFELRAICELLAEAIATRITALES

SEQ ID NO: 787 - protein, 316 aa, Rhodopseudomonas palustris CGA009
MTEGSVARQPDLSTCDDEPIHIPGAIQPHGLLLALAADMTIVAGSDNLPELTGLAIGALIGRSAADVFDSETHNRLTIALAEPGAAVGAPIAVGFTMRKDAGFVGSWHRHDQLVFLELEPPQRDVAEPQAFFRRTNSAIRRLQAAETLESACAAAAQEVREITGFDRVMIYRFASDFSGEVIAEDRCAEVESYLGLHFPASDIPAQARRLYTINPVRIIPDINYRPVPVTPDLNPVTGRPIDLSFAILRSVSPVHLEYMRNIGMHGTMSISILRGERLWGLIACHHRKPNYVDLDGRQACELVAQVLAWQIGVMEE

SEQ ID NO: 788 - protein, 311 aa, Rhodopseudomonas palustris CGA009
MPRKVDLTSCDREPIHIPGSIQPCGCLLACDAQAVRITRISENAGAFFGRETPRVGELLADYFGETEAHALRNALAQSSDPKRPALIFGWRDGLTGRTFDISLHRHDGTSIVEFEPAAADQADNPLRLTRQIIARTKELKSLEEMAARVPRYLQAMLGYHRVMMYRFADDGSGKVIGEAKRSDLESFLGQHFPASDIPQQARLLYLKNAIRVISDSRGISSRIVPERDASGAALDLSFAHLRSVSPIHLEYLRNMGVSASMSLSIIIDGTLWGLIACHHYEPRAVPMAQRVAAEMFADFFSLHFTAAHHQR

SEQ ID NO: 789 - protein, 233 aa, Renilla reniformis
MDLAKLGLKEVMPTKINLEGLVGDHAFSMEGVGEGNILEGTQEVKISVTKGAPLPFAFDIVSVAFSYGNRAYTGYPEEISDYFLQSFPEGFTYERNIRYQDGGTAIVKSDISLEDGKFIVNVDFKAKDLRRMGPVMQQDIVGMQPSYESMYTNVTSVIGECIIAFKLQTGKHFTYHMRTVYKSKKPVETMPLYHFIQHRLVKTNVDTASGYVVQHETAIAAHSTIKKIEGSLP

SEQ ID NO: 790 - protein, 235 aa, Renilla reniformis
MDLAKLGLKEVMPTKINLEGLVGDHAFSMEGVGEGNILEGTQEVKISVTKGAPLPFAFDIVSVAFGYGNRAYTGYPEEISDYFLQSFPEGFTYERNIRYQDGGTAIVKSDISLEDGKFIVNVDFKAKDLRRMGPVMQQDIVGMQPSYESMYTNVTSVIGECIIAFKLQTGKHFTYHMRTVYKSKKPVETMPLYHFIQHRLVKTNVDTASGYVVQHETAIAAHSTIKKIEGSLPVD

SEQ ID NO: 791 - protein, 238 aa, Aequorea victoria
MSKGEELFTGVVPILVELDGDVNGHKFSVSGEGEGDATYGKLTLKFICTTGKLPVPWPTLVTTGSYGLLCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 792 - protein, 238 aa, Aequorea victoria
MSKGEELFTGVVPILVELDGDVNGHKFSVSGEGEGDATYGKLTLKFICTTGKLPVPWPTLVTTLLYGAQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 793 - protein, 238 aa, Aequorea victoria
MSKGEELFTGVVPILVELDGDVNGHKFSVSGEGEGDATYGKLTLKFICTTGKLPVPWPTLVTTGCYGMNCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 794 - protein, 238 aa, Aequorea victoria
MSKGEELFTGVVPILVELDGDVNGHKFSVSGEGEGDATYGKLTLKFICTTGKLPVPWPTLVTTMGYGVLCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 795 - protein, 238 aa, Aequorea victoria
MSKGEELFTGVVPILVELDGDVNGHKFSVSGEGEGDATYGKLTLKFICTTGKLPVPWPTLVTTVAYGMLCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 796 - protein, 238 aa, Aequorea victoria
MSKGEELFTGVVPILVELDGDVNGHKFSVSGEGEGDATYGKLTLKFICTTGKLPVPWPTLVTTLCYGTVCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 797 - protein, 221 aa, Montipora efflorescens
GGVIATQMTYKVYMSGTVNGHYFEVEGDGKGRPYEGEQTVKLTVTKGGPLPFAWDILSPQCQYGSIPFTKYPEDIPDYVKQSFPEGFTWERIMNFEDGAVCTVSNDSSIQGNCFTYHVKFSGLNFPPNGPVMQKKTQGWEPHSERLFARGGMLIGNNFMALKLEGGGHYLCEFKTTYKAKKPVKMPGYHYVDRKLDVTNHNKDYTSVEQCEISIARKPVVA

SEQ ID NO: 798 - protein, 222 aa, Stylocoeniella armata
MALSKQYIPDDMELIFHMDGCVNGHYFTIVATGKAKPYEGKQNLKATVTKGAPLPFSTDILSTVMHYGNRCIVHYPPGILDYFKQSFPEGYSWERTFAFEDGGFCTASADIKLKDNCFIHTSMFHGVNFPADGPVMQRKTIQWEKSIEKMTVSDGIVKGDITMFLLLEGGGKYRCQFHTSYKAKKVVEMPQSHYVEHSIERTNDDGTQFELNEHAVARLNEI

SEQ ID NO: 799 - protein, 147 aa, Scleractinia sp. Lizard Island 38
MSVIKPDMKMKLRMEGAVNGHKFVIAGEGRGQPFEGKQTMDLTVKEGGPLPFAFDILTTVFDYGNRVFVKYPRDIADYFKQSFPEGFSWERSMAYEDGGICIATNNITLMKGDCFLYEIRFDGVNFPANSPVMQKRTVKWEPSTEKL

SEQ ID NO: 800 - protein, 146 aa, Scleractinia sp. Lizard Island 38
MSVIKPDMKMKLRMEGAVNGHKFVIAGEGRGQPFEGKQTMNLEVLVGGPLPFAFDILTTVFDYGNRVFVKYPNDIADYFKQSFPEGFSWERSMAYEDGGICLATNDITLNGDCFLYEIRFDGVNFPANSPVMQKRTVKWEPSTEKL

SEQ ID NO: 801 - protein, 234 aa, Scolymia cubensis
  MISC_FEATURE (133)...(133): Xaa is any amino acid
  MISC_FEATURE (170)...(170): Xaa is any amino acid
MQRAGMKVKEHMKIKLRMGGTVNGKHFAVNGTGDGYPYQGKQILKLIVEGSEPLPFAFDILSAAFQYGNRAFTEYPTEIADYFKQSFEFGEGFSWERSFTFEDGAICVATNDITMVGGEFQYDIRFDGLNFPXDGPVMQKKTVKWEPSTEIMYMQNGVLKGEVNMALLLXDKSHYRCDLKTTYKAKNNVPHPPGYHYVDHCIEILEERKDHVKLREHAKARSSLSPTSAKERKA

SEQ ID NO: 802 - protein, 235 aa, Scolymia cubensis
  MISC_FEATURE (198)...(198): Xaa is any amino acid
MQSAGKKNVVKDFMKITLRMDGAVNGKPFAVNGTGDGNPYGGIQSLKLTVDGNKPLPFAFDILSAAFQYGNRAFTEYPKEISDYFKQSFEFGEGFTWERSFTFEDGAICVATNDIKMVGDEFQYNIRFDGVNFPEDGPVMQKKTVKWEPSTEIMRVQGGVLKGEVNMALLLKDKSHYRCDFKTTYKAKNPVPPTALPXYHYVDHCIEITEENRDYVKLQEYAKARSGLHLPELQK

SEQ ID NO: 803 - protein, 234 aa, Entacmaea quadricolor
MSEELIKENMHMKLYMEGTVDNHHFKATSEGEGKPYEGTQTMRIKVVEGGPLPFAFDILATSFLYGSKTFIDHTQGIPDFFKQSFPEGFTWERVTTYEDGGVLTATQDTSLQDGSLIYNVKIRGVDFTSNGPVMQKKTLGWEAFTETLYPADGGLEGRNDMALKLVGGSHLIANAKTTYRSKKPAKNLKMPGVYYVDYRLERIKEANDETYVEQHEVAVARYSDLPSKLGHKLN

SEQ ID NO: 804 - protein, 226 aa, Discosoma sp.
MEEDNMAIIKEFMRFKVHMEGSVNGHEFEIEGEGEGHPYEGTQTAKLKVTKGGPLPFAWDILSPQFMYGSKAYVKHPADIPDYLKLSFPEGFTWERVMNFEDGGVVTVTQDSSLQDGEFIYKVKLLGTNFPSDGPVMQKKTMGWEASTERMYPEDGALKGEINQRLKLKDGGHYDAEVKTTYKAKKPVQLPGAYNVDIKLDITSHNEDYTIVEQYERAEGRHSTGG

SEQ ID NO: 805 - protein, 223 aa, Discosoma sp.
EEDNMAIIKEFMRFKVHMEGSVNGHEFEIEGEGEGHPYEGTQTAKLKVTKGGPLPFAWDILSPQFMYGSKAYVKHPADIPDYLKLSFPEGFTWERVMNFEDGGVVTVTQDSSLQDGQFIYKVKLLGINFPSDGPVMQKKTMGWEASTERMYPEDGALKGEINQRLKLKDGGHYDAEVKTTYKAKKPVQLPGAYNVDIKLDITSHNEDYTIVEQYERAEARHST

SEQ ID NO: 806 - protein, 224 aa, Discosoma sp.
MEEDNMAIIKEFMRFKVHMEGSVNGHEFEIEGEGEGHPYEGTQTARLKVTKGDPLPFAWDILSPQFMYGSKAYVKHPADIPDYLKLSFPEGFTWERVMNFEDGGVVAVTQDSSLQDGQFIYKVKLLGINFPSDGPVMQKKTMGWEASTERMYPEDGALKGEINQRLKLKDGGHYDAEVKTTYRAKKPVQLPGAYDVDIKLDITSHNEDYTIVEQYERAEARHST

SEQ ID NO: 807 - protein, 111 aa, Arabidopsis thaliana
MIEKNYVITDPRLPDNPIIFASDGFLELTEYSREEILGRNARFLQGPETDQATVQKIRDAIRDQRETTVQLINYTKSGKEFWNLFHLQPVRNQKGELQYFIGVQQDGSDHV

SEQ ID NO: 808 - protein, 238 aa, Aequorea macrodactyla
MSKGEELFTGVVPILVELDGDVHGHKFSVRGEGEGDADYGKLEIKFICTTGKLPVPWPTLVTTLGYGILCFARYPEHMKMNDFFKSAMPEGYIQERTIFFQDDGKYKTRGEVKFEGDTLVNRIELKGMDFKEDGNILGHKLEYNFNSHNVYIMPDKANNGLKVNFKIRHNIEGGGVQLADHYQTNVPLGDGPVLIPINHYLSTQTAISKDRNETRDHMVFLEFFSACGHTHGMDELYK

SEQ ID NO: 809 - protein, 224 aa, Stylophora pistillata
MSHSKQALADTMKMTWLMEGSVNGHAFTIEGEGTGKPYEGKQSGTFRVTKGGPLPFAFDIVAPTLKYGFKCFMKYPADIPDYFKLAFPEGLTYDRKIAFEDGGCATATVEMSLKGNTLVHKTNFQGGNFPIDGPVMQKRTLGWEPTSEKMTPCDGIIKGDTIMYLMVEGGKTLKCRYENNYRANKPVLMPPSHFVDLRLTRTNLDKEGLAFKLEEYAVARVLEV

SEQ ID NO: 810 - protein, 221 aa, Stylocoeniella sp. NOA-2005
MSVIAKQMTYKVYMSGTVNGHYFEVQGDGKGKPYEGEQTVRLTVTKGGPLPFAWDILSPLSQYGSIPFTKYPEDIPDYVKQSFPEGYTWERIMNFEDGAVCTVSNDSSIQGNCFIYNVKISGLNFPPNGPVMQKKTQGWEPNTERLFARDGMLIGNNFMALKLEGGGHYLCEFKSTYKAKKPVRMPGYHYVDRKLDVTSHNRDYTSVEQCEISIARHSLLG

SEQ ID NO: 811 - protein, 239 aa, Aequorea victoria
MVSKGEELFTGVVPILVELDGDVNGHKFSVRGEGEGDATNGKLTLKFICTTGKLPVPWPTLVTTLSWGVQCFARYPDHMKQHDFFKSAMPEGYVQERTISFKDDGTYKTRAEVKFEGDTLVNRIELKGIDFKEDGNILGHKLEYNYFSDNVYITADKQKNGIKANFKIRHNVEDGGVQLADHYQQNTPIGDGPVLLPDNHYLSTQSKLSKDPNEKRDHMVLLEFVTAAGITLGMDELYK

SEQ ID NO: 812 - protein, 239 aa, Aequorea victoria
MVSKGEELFTGVVPILVELDGDVNGHKFSVRGEGEGDATNGKLTLKFICTTGKLPVPWPTLVTTLSWGVQVFARYPDHMKQHDFFKSAMPEGYVQERTISFKDDGTYKTRAEVKFEGDTLVNRIELKGIDFKEDGNILGHKLEYNYFSDNVYITADKQKNGIKANFKIRHNVEDGGVQLADHYQQNTPIGDGPVLLPDNHYLSTQSKLSKDPNEKRDHMVLLEFVTAAGITLGMDELYK

SEQ ID NO: 813 - protein, 224 aa, Scleractinia sp. Lizard Island 37
  MISC_FEATURE (73)...(73): Xaa is any amino acid
  MISC_FEATURE (76)...(76): Xaa is any amino acid
  MISC_FEATURE (77)...(77): Xaa is any amino acid
  MISC_FEATURE (127)...(127): Xaa is any amino acid
  MISC_FEATURE (129)...(129): Xaa is any amino acid
  MISC_FEATURE (146)...(146): Xaa is any amino acid
MSVIKADMKMKLRMVGAVNGHKFEIAGEGKGKPFEGKQTMDLKVLVGGPLPFAYDILTTVFDYGNRVFVKYPXDIXXYFKQSFPEGFSWQRSMAYEDGGICLATNDITLNGDCFLYEIRFDGVNFPXNXPVMQKKTVKWEPSTEKXYVRDGVLKGDVNMALLLEGGGHYRCDFKTTYISKKVVQLPDYHFVDHRIEIESHDKDYNNVKLYEHAEAHSGLPRQAK

SEQ ID NO: 814 - protein, 132 aa, Trichodesmium erythraeum IMS101
MKTGEQRVKIATLLSENEKKIVDKASQDLWRRRPDFIAPGGNAFGQRERALCLRDYGWYLRLITYGLLAGDKDPIESIGLIGVREMYNSLGVPVPGMVESIRCLKEASLSLLDEEDAKETAPYFDYIIQAMS

SEQ ID NO: 815 - protein, 243 aa, Zoanthus sp.
MVSKGEEHSKHGLKEEMTMKYHMEGCVNGHKFVITGEGIGYPFKGKQTINLCVIEGGPLPFSEDILSAGFKYGDRIFTEYPQDIVDYFKNSCPAGYTWGRSFLFEDGAVCICNVDITVSVKENCIYHKSIFNGVNFPADGPVMKKMTTNWEASCEKIMPVPKQGILKGDVSMYLLLKDGGRYRCQFDTVYKAKSVPSKMPEWHFIQHKLLREDRSDAKNQKWQLTEHAIAFPSALAGMDELYK

SEQ ID NO: 816 - protein, 229 aa, Aequorea victoria
KSKGEELFAGVVPILVELDGDVNGHKFSVSGEGEGDATYGKLTLKFICTTGKLPVPFPTLVTTLSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHCLSTQTVLSKDPNEKRDHMVLLEFVTAAGI

SEQ ID NO: 817 - protein, 222 aa, Stylocoeniella armata
MALSKQYIPDDMELIFHMDGCVNGHYFTIVATGKAKPYEGKQNLKATVTKGAPLPFSTDILSTVMHYGNRCIVHYPPGILDYFKQSFPEGYSWERTFAFEDGGFCTASADIKLKDNCFIHTSMFHGTNFPADGPVMQRKTIQWEKSIEKMTVSDGIVKGDITMFLLLEGGGKYRCQFHTSYKAKKVVEMPQSHYVEHSIERTNDDGTQFELNEHAVARLNEI

SEQ ID NO: 818 - protein, 238 aa, Aequorea victoria
MSKGEELFTGVVPILVELDGDVNGHKFSVRGEGEGDATNGKLTLKFICTTGKLPVPWPTLVTTLTYGVQCFSRYPDHMKRHDFFKSAMPEGYVQERTISFKDDGTYKTRAEVKFEGDTLVNRIELKGIDFKEDGNILGHKLEYNFNSHNVYITADKQKNGIKAYFKIRHNVEDGSVQLADHYQQNTPIGDGPVLLPDNHYLSTQSVLSKDPNEKRDHMVLLEFVTAAGITHGMDELYK

SEQ ID NO: 819 - protein, 239 aa, Aequorea victoria
MVSKGEELFTGVVPILVELDGDVNGHKFSVSGEGEGDATYGKLTLKFICTTGKLPVPWPTLVTTFGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 820 - protein, 238 aa, Aequorea victoria
MSKGEELFTGVVPILVELDGDVNGHKFSVSGEGEGDATYGKLTLKLLCTTGKLPVPWPTLVTTFGYGLQCFARYPDHMKRHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALFKDPNEKRDHMVLLEFLTAAGITEGMNELYK

SEQ ID NO: 821 - protein, 231 aa, Zoanthus sp.
MAYSKQGLTDNMTMKYQMEGCVDGHQFVITGHGKGNPFTGKQTLNLCVDKGGPLPFSEDILSAVFTYGNRIFADYPQDIDDYFKNSCPAGYTWTRSFLFEDGAVAIASADIRLSVQEKCFHHVSRFYGVNFPADGPVMKKMTTDWEPSTEKIIPVPSQGILKGDASMYLLLKDGGRYRCQFDSVYKAKSKPKVMPDWHFIQHKLTREDRSDAKNQKWQLVEHASASRSALP

SEQ ID NO: 822 - protein, 231 aa, Zoanthus sp.
MAHSKHGLTDDMTMHFRMEGCVDGHKFVIEGNGNGNPFKGKQFINLCVIEGGPLPFSEDILSAAFDYGNRLFTEYPEGIVDYFKNSCPAGYTWHRSFRFEDGAVCICSADITVNVRENCIYHESTFYGVNFPADGPVMKKMTTNWEPSCEKIIPINSQKILKGDVSMYLLLKDGGRYRCQFDTIYKAKTEPKEMPDWHFIQHKLNREDRSDAKNQKWQLIEHAIASRSALP

SEQ ID NO: 823 - protein, 229 aa, Zoanthus sp.
MAHSKHGLTNDMTMKFRMEGCVDGHQFVITGHGNGNPFTGEQTINLCVDKGGPLPFSEDILSAAFDYGNRLFTEYPQGIVDYFKNSCPAGYTWQRSFLFEDGAVCIASADISVKENCIHHYSTFYGVNFPVDGPVMKKVTYNWEPSCEKIIPIPSQEILKGDVSMYLLLKDGGRYRCQFDTIYKAKSKPKVMPDWHFIQHKLTREDRSDAKNQKWQLVEHAVASRSALP

SEQ ID NO: 824 - protein, 514 aa, Escherichia coli
MDVIKKKHWWQSDALKWSVLGLLGLLVGYLVVLMYAQGEYLFAITTLILSSAGLYIFANRKAYAWRYVYPGMAGMGLFVLFPLVCTIAIAFTNYSSTNQLTFERAQEVLLDRSWQAGKTYNFGLYPAGDEWQLALSDGETGKNYLSDAFKFGGEQKLQLKETTAQPEGERANLRVITQNRQALSDITAILPDGNKVMMSSLRQFSGTQPLYTLDGDGTLTNNQSGVKYRPNNQIGFYQSITADGNWGDEKLSPGYTVTTGWKNFTRVFTDEGIQKPFLAIFVWTVVFSLITVFLTVAVGMVLACLVQWEALRGKAVYRVLLILPYAVPSFISILIFKGLFNQSFGEINMMLSALFGVKPAWFSDPTTARTMLIIVNTWLGYPYMMILCMGLLKAIPDDLYEASAMDGAGPFQNFFKITLPLLIKPLTPLMIASFAFNFNNFVLIQLLTNGGPDRLGTTTPAGYTDLLVNYTYRIAFEGGGGQDFGLAAAIATLIFLLVGALAIVNLKATRMKFD

SEQ ID NO: 825 - protein, 296 aa, Escherichia coli
MAMVQPKSQKARLFITHLLLLLFIAAIMFPLLMVVAISLRQGNFATGSLIPEQISWDHWKLALGFSVEQADGRITPPPFPVLLWLWNSVKVAGISAIGIVALSTTCAYAFARMRFPGKATLLKGMLIFQMFPAVLSLVALYALFDRLGEYIPFIGLNTHGGVIFAYLGGIALHVWTIKGYFETIDSSLEEAAALDGATPWQAFRLVLLPLSVPILAVVFILSFIAAITEVPVASLLLRDVNSYTLAVGMQQYLNPQNYLWGDFAAAAVMSALPITIVFLLAQRWLVNGLTAGGVKG

SEQ ID NO: 826 - protein, 308 aa, Escherichia coli
MSEQFLYFLQQMFNGVTLGSTYALIAIGYTMVYGIIGMINFAHGEVYMIGSYVSFMIIAALMMMGIDTGWLLVAAGFVGAIVIASAYGWSIERVAYRPVRNSKRLIALISAIGMSIFLQNYVSLTEGSRDVALPSLFNGQWVVGHSENFSASITTMQAVIWIVTFLAMLALTIFIRYSRMGRACRACAEDLKMASLLGINTDRVIALTFVIGAAMAAVAGVLLGQFYGVINPYIGFMAGMKAFTAAVLGGIGSIPGAMIGGLILGIAEALSSAYLSTEYKDVVSFALLILVLLVMPTGILGRPEVEKV

SEQ ID NO: 827 - protein, 241 aa, Escherichia coli
MDSLNLNKHISGQFNAELESIRTQVMTMGGMVEQQLSDAITAMHNQDSDLAKRVIEGDKNVNMMEVAIDEACVRIIAKRQPTASDLRLVMVISKTIAELERIGDVADKICRTALEKFSQQHQPLLVSLESLGRHTIQMLHDVLDAFARMDIDEAVRIYREDKKVDQEYEGIVRQLMTYMMEDSRTIPSVLTALFCARSIERIGDRCQNICEFIFYYVKGQDFRHVGGDELDKLLAGKDSDK

SEQ ID NO: 828 - protein, 773 aa, Escherichia coli
MKKLTIGLIGNPNSGKTTLFNQLTGSRQRVGNWAGVTVERKEGQFSTTDHQVTLVDLPGTYSLTTISSQTSLDEQIACHYILSGDADLLINVVDASNLERNLYLTLQLLELGIPCIVALNMLDIAEKQNIRIEIDALSARLGCPVIPLVSTRGRGIEALKLAIDRYKANENVELVHYAQPLLNEADSLAKVMPSDIPLKQRRWLGLQMLEGDIYSRAYAGEASQHLDAALARLRNEMDDPALHIADARYQCIAAICDVVSNTLTAEPSRFTTAVDKIVLNRFLGLPIFLFVMYLMFLLAINIGGALQPLFDVGSVALFVHGIQWIGYTLHFPDWLTIFLAQGLGGGINTVLPLVPQIGMMYLFLSFLEDSGYMARAAFVMDRLMQALGLPGKSFVPLIVGFGCNVPSVMGARTLDAPRERLMTIMMAPFMSCGARLAIFAVFAAAFFGQNGALAVFSLYMLGIVMAVLTGLMLKYTIMRGEATPFVMELPVYHVPHVKSLIIQTWQRLKGFVLRAGKVIIIVSIFLSAFNSFSLSGKIVDNINDSALASVSRVITPVFKPIGVHEDNWQATVGLFTGAMAKEVVVGTLNTLYTAENIQDEEFNPAEFNLGEELFSAIDETWQSLKDTFSLSVLMNPIEASKGDGEMGTGAMGVMDQKFGSAAAAYSYLIFVLLYVPCISVMGAIARESSRGWMGFSILWGLNIAYSLATLFYQVASYSQHPTYSLVCILAVILFNIVVIGLLRRARSRVDIELLATRKSVSSCCAASTTGDCH

SEQ ID NO: 829 - protein, 418 aa, Escherichia coli
MNLKLQLKILSFLQFCLWGSWLTTLGSYMFVTLKFDGASIGAVYSSLGIAAVFMPALLGIVADKWLSAKWVYAICHTIGAITLFMAAQVTTPEAMFLVILINSFAYMPTLGLINTISYYRLQNAGMDIVTDFPPIRIWGTIGFIMAMWVVSLSGFELSHMQLYIGAALSAILVLFTLTLPHIPVAKQQANQSWTTLLGLDAFALFKNKRMAIFFIFSMLLGAELQITNMFGNTFLHSFDKDPMFASSFIVQHASIIMSISQISETLFILTIPFFLSRYGIKNVMMISIVAWILRFALFAYGDPTPFGTVLLVLSMIVYGCAFDFFNISGSVFVEKEVSPAIRASAQGMFLMMTNGFGCILGGIVSGKVVEMYTQNGITDWQTVWLIFAGYSVVLAFAFMAMFKYKHVRVPTGTQTVSH

SEQ ID NO: 830 - protein, 255 aa, Escherichia coli
MSQPLLSVNGLMMRFGGLLAVNNVNLELYPQEIVSLIGPNGAGKTTVFNCLTGFYKPTGGTILLRDQHLEGLPGQQIARMGVVRTFQHVRLFREMTVIENLLVAQHQQLKTGLFSGLLKTPSFRRAQSEALDRAATWLERIGLLEHANRQASNLAYGDQRRLEIARCMVTQPEILMLDEPAAGLNPKETKELDELIAELRNHHNTTILLIEHDMKLVMGISDRIYVVNQGTPLANGTPEQIRNNPDVIRAYLGEA

SEQ ID NO: 831 - protein, 428 aa, Escherichia coli
MKTSLFKSLYFQVLTAIAIGILLGHFYPEIGEQMKPLGDGFVKLIKMIIAPVIFCTVVTGIAGMESMKAVGRTGAVALLYFEIVSTIALIIGLIIVNVVQPGAGMNVDPATLDAKAVAVYADQAKDQGIVAFIMDVIPASVIGAFASGNILQVLLFAVLFGFALHRLGSKGQLIFNVIESFSQVIFGIINMIMRLAPIGAFGAMAFTIGKYGVGTLVQLGQLIICFYITCILFVVLVLGSIAKATGFSIFKFIRYIREELLIVLGTSSSESALPRMLDKMEKLGCRKSVVGLVIPTGYSFNLDGTSIYLTMAAVFIAQATNSQMDIVHQITLLIVLLLSSKGAAGVTGSGFIVLAATLSAVGHLPVAGLALILGIDRFMSEARALTNLVGNGVATIVVAKWVKELDHKKLDDVLNNRAPDGKTHELSS

SEQ ID NO: 832 - protein, 217 aa, Escherichia coli
MSEPMMWLLVRGVWETLAMTFVSGFFGFVIGLPVGVLLYVTRPGQIIANAKLYRTVSAIVNIFRSIPFIILLVWMIPFTRVIVGTSIGLQAAIVPLTVGAAPFIARMVENALLEIPTGLIEASRAMGATPMQIVRKVLLPEALPGLVNAATITLITLVGYSAMGGAVGAGGLGQIGYQYGYIGYNATVMNTVLVLLVILVYLIQFAGDRIVRAVTRK

SEQ ID NO: 833 - protein, 354 aa, Escherichia coli
MADQNNPWDTTPAADSAAQSADAWGTPTTAPTDGGGADWLTSTPAPNVEHFNILDPFHKTLIPLDSWVTEGIDWVVTHFRPVFQGVRVPVDYILNGFQQLLLGMPAPVAIIVFALIAWQISGVGMGVATLVSLIAIGAIGAWSQAMVTLALVLTALLFCIVIGLPLGIWLARSPRAAKIIRPLLDAMQTTPAFVYLVPIVMLFGIGNVPGVVVTIIFALPPIIRLTILGINQVPADLIEASRSFGASPRQMLFKVQLPLAMPTIMAGVNQTLMLALSMVVIASMIAVGGLGQMVLRGIGRLDMGLATVGGVGIVILAIILDRLTQAVGRDSRSRGNRRWYTTGPVGLLTRPFIK

SEQ ID NO: 834 - protein, 141 aa, Escherichia coli
MAMHLNENLDDNGEMHDINVTPFIDVMLVLLIIFMVAAPLATVDVKVNLPASTSTPQPRPEKPVYLSVKADNSMFIGNDPVTDETMITALNALTEGKKDTTIFFRADKTVDYETLMKVMDTLHQAGYLKIGLVGEETAKAK

SEQ ID NO: 835 - protein, 508 aa, Escherichia coli
MSMSSIPSSSQSGKLYGWVERIGNKVPHPFLLFIYLIIVLMVTTAILSAFGVSAKNPTDGTPVVVKNLLSVEGLHWFLPNVIKNFSGFAPLGAILALVLGAGLAERVGLLPALMVKMASHVNARYASYMVLFIAFFSHISSDAALVIMPPMGALIFLAVGRHPVAGLLAAIAGVGCGFTANLLIVTTDVLLSGISTEAAAAFNPQMHVSVIDNWYFMASSVVVLTIVGGLITDKIIEPRLGQWQGNSDEKLQTLTESQRFGLRIAGVVSLLFIAAIALMVIPQNGILRDPINHTVMPSPFIKGIVPLIILFFFVVSLAYGIATRTIRRQADLPHLMIEPMKEMAGFIVMVFPLAQFVAMFNWSNMGKFIAVGLTDILESSGLSGIPAFVGLALLSSFLCMFIASGSAIWSILAPIFVPMFMLLGFHPAFAQILFRIADSSVLPLAPVSPFVPLFLGFLQRYKPDAKLGTYYSLVLPYPLIFLVVWLLMLLAWYLVGLPIGPGIYPRLS

SEQ ID NO: 836 - protein, 244 aa, Escherichia coli
MGNNLMQTDLSVWGMYQHADIVVKCVMIGLILASVVTWAIFFSKSVEFFNQKRRLKREQQLLAEARSLNQANDIAADFGSKSLSLHLLNEAQNELELSEGSDDNEGIKERTSFRLERRVAAVGRQMGRGNGYLATIGAISPFVGLFGTVWGIMNSFIGIAQTQTTNLAVVAPGIAEALLATAIGLVAAIPAVVIYNVFARQIGGFKAMLGDVAAQVLLLQSRDLDLEASAAAHPVRVAQKLRAG

SEQ ID NO: 837 - protein, 535 aa, Escherichia coli
MRISLKKSGMLKLGLSLVAMTVAASVQAKTLVYCSEGSPEGFNPQLFTSGTTYDASSVPLYNRLVEFKIGTTEVIPGLAEKWEVSEDGKTYTFHLRKGVKWHDNKEFKPTRELNADDVVFSFDRQKNAQNPYHKVSGGSYEYFEGMGLPELISEVKKVDDNTVQFVLTRPEAPFLADLAMDFASILSKEYADAMMKAGTPEKLDLNPIGTGPFQLQQYQKDSRIRYKAFDGYWGTKPQIDTLVFSITPDASVRYAKLQKNECQVMPYPNPADIARMKQDKSINLMEMPGLNVGYLSYNVQKKPLDDVKVRQALTYAVNKDAIIKAVYQGAGVSAKNLIPPTMWGYNDDVQDYTYDPEKAKALLKEAGLEKGFSIDLWAMPVQRPYNPNARRMAEMIQADWAKVGVQAKIVTYEWGEYLKRAKDGEHQTVMMGWTGDNGDPDNFFATLFSCAASEQGSNYSKWCYKPFEDLIQPARATDDHNKRVELYKQAQVVMHDQAPALIIAHSTVFEPVRKEVKGYVVDPLGKHHFENVSIE

SEQ ID NO: 838 - protein, 222 aa, Escherichia coli
MQESIQLVIDSLPFLLKGAGYTLQLSIGGMFFGLLLGFILALMRLSPIWPVRWLARFYISIFRGTPLIAQLFMIYYGLPQFGIELDPIPSAMIGLSLNTAAYAAETLRAAISSIDKGQWEAAASIGMTPWQTMRRAILPQAARVALPPLSNSFISLVKDTSLAATIQVPELFRQAQLITSRTLEVFTMYLAASLIYWIMATVLSTLQNHFENQLNRQEREPK

SEQ ID NO: 839 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 840 - protein, 400 aa, Escherichia coli
MDRVLHFVLALAVVAILALLVSSDRKKIRIRYVIQLLVIEVLLAWFFLNSDVGLGFVKGFSEMFEKLLGFANEGTNFVFGSMNDQGLAFFFLKVLCPIVFISALIGILQHIRVLPVIIRAIGFLLSKVNGMGKLESFNAVSSLILGQSENFIAYKDILGKISRNRMYTMAATAMSTVSMSIVGAYMTMLEPKYVVAALVLNMFSTFIVLSLINPYRVDASEENIQMSNLHEGQSFFEMLGEYILAGFKVAIIVAAMLIGFIALIAALNALFATVTGWFGYSISFQGILGYIFYPIAWVMGVPSSEALQVGSIMATKLVSNEFVAMMDLQKIASTLSPRAEGIISVFLVSFANFSSIGIIAGAVKGLNEEQGNVVSRFGLKLVYGSTLVSVLSASIAALVL

SEQ ID NO: 841 - protein, 183 aa, Escherichia coli
MQTKKNEIWVGIFLLAALLAALFVCLKAANVTSIRTEPTYTLYATFDNIGGLKARSPVSIGGVVVGRVADITLDPKTYLPRVTLEIEQRYNHIPDTSSLSIRTSGLLGEQYLALNVGFEDPELGTAILKDGDTIQDTKSAMVLEDLIGQFLYGSKGDDNKNSGDAPAAAPGNNETTEPVGTTK

SEQ ID NO: 842 - protein, 439 aa, Escherichia coli
MTHQLRSRDIIALGFMTFALFVGAGNIIFPPMVGLQAGEHVWTAAFGFLITAVGLPVLTVVALAKVGGGVDSLSTPIGKVAGVLLATVCYLAVGPLFATPRTATVSFEVGIAPLTGDSALPLFIYSLVYFAIVILVSLYPGKLLDTVGNFLAPLKIIALVILSVAAIVWPAGSISTATEAYQNAAFSNGFVNGYLTMDTLGAMVFGIVIVNAARSRGVTEARLLTRYTVWAGLMAGVGLTLLYLALFRLGSDSASLVDQSANGAAILHAYVQHTFGGGGSFLLAALIFIACLVTAVGLTCACAEFFAQYVPLSYRTLVFILGGFSMVVSNLGLSQLIQISVPVLTAIYPPCIALVVLSFTRSWWHNSSRVIAPPMFISLLFGILDGIKASAFSDILPSWAQRLPLAEQGLAWLMPTVVMVVLAIIWDRAAGRQVTSSAH

SEQ ID NO: 843 - protein, 546 aa, Escherichia coli
MESNNGEAKIQKVKNWSPVWIFPIVTALIGAWVLFYHYSHQGPEVTLITANAEGIEGGKTTIKSRSVDVGVVESATLADDLTHVEIKARLNSGMEKLLHKDTVFWVVKPQIGREGISGLGTLLSGVYIELQPGAKGSKMDKYDLLDSPPLAPPDAKGIRVILDSKKAGQLSPGDPVLFRGYRVGSVETSTFDTQKRNISYQLFINAPYDRLVTNNVRFWKDSGIAVDLTSAGMRVEMGSLTTLLSGGVSFDVPEGLDLGQPVAPKTAFVLYDDQKSIQDSLYTDHIDYLMFFKDSVRGLQPGAPVEFRGIRLGTVSKVPFFAPNMRQTFNDDYRIPVLIRIEPERLKMQLGENADVVEHLGELLKRGLRGSLKTGNLVTGALYVDLDFYPNTPAITGIREFNGYQIIPTVSGGLAQIQQRLMEALDKINKLPLNPMIEQATSTLSESQRTMKNLQTTLDSMNKILASQSMQQLPTDMQSTLRELNRSMQGFQPGSAAYNKMVADMQRLDQVLRELQPVLKTLNEKSNALVFEAKDKKDPEPKRAKQ

SEQ ID NO: 844 - protein, 437 aa, Escherichia coli
MKNIKFSLAWQILFAMVLGILLGSYLHYHSDSRDWLVVNLLSPAGDIFIHLIKMIVVPIVISTLVVGIAGVGDAKQLGRIGAKTIIYFEVITTVAIILGITLANVFQPGAGVDMSQLATVDISKYQSTTEAVQSSSHGIMGTILSLVPTNIVASMAKGEMLPIIFFSVLFGLGLSSLPATHREPLVTVFRSISETMFKVTHMVMRYAPVGVFALIAVTVANFGFSSLWPLAKLVLLVHFAILFFALVVLGIVARLCGLSVWILIRILKDELILAYSTASSESVLPRIIEKMEAYGAPVSITSFVVPTGYSFNLDGSTLYQSIAAIFIAQLYGIDLSIWQEIILVLTLMVTSKGIAGVPGVSFVVLLATLGSVGIPLEGLAFIAGVDRILDMARTALNVVGNALAVLVIAKWEHKFDRKKALAYEREVLGKFDKTADQ

SEQ ID NO: 845 - protein, 425 aa, Escherichia coli
MKPMHIAMALLSAAMFFVLAGVFMGVQLELDGTKLVVDTASDVRWQWVFIGTAVVFFFQLLRPAFQKGLKSVSGPKFILPAIDGSTVKQKLFLVALLVLAVAWPFMVSRGTVDIATLTMIYIILGLGLNVVVGLSGLLVLGYGGFYAIGAYTFALLNHYYGLGFWTCLPIAGLMAAAAGFLLGFPVLRLRGDYLAIVTLGFGEIVRILLLNNTEITGGPNGISQIPKPTLFGLEFSRTAREGGWDTFSNFFGLKYDPSDRVIFLYLVALLLVVLSLFVINRLLRMPLGRAWEALREDEIACRSLGLSPRRIKLTAFTISAAFAGFAGTLFAARQGFVSPESFTFAESAFVLAIVVLGGMGSQFAVILAAILLVVSRELMRDFNEYSMLMLGGLMVLMMIWRPQGLLPMTRPQLKLKNGAAKGEQA

SEQ ID NO: 846 - protein, 446 aa, Escherichia coli
MSQKTLFTKSALAVAVALISTQAWSAGFQLNEFSSSGLGRAYSGEGAIADDAGNVSRNPALITMFDRPTFSAGAVYIDPDVNISGTSPSGRSLKADNIAPTAWVPNMHFVAPINDQFGWGASITSNYGLATEFNDTYAGGSVGGTTDLETMNLNLSGAYRLNNAWSFGLGFNAVYARAKIERFAGDLGQLVAGQIMQSPAGQTQQGQALAATANGIDSNTKIAHLNGNQWGFGWNAGILYELDKNNRYALTYRSEVKIDFKGNYSSDLNRAFNNYGLPIPTATGGATQSGYLTLNLPEMWEVSGYNRVDPQWAIHYSLAYTSWSQFQQLKATSTSGDTLFQKHEGFKDAYRIALGTTYYYDDNWTFRTGIAFDDSPVPAQNRSISIPDQDRFWLSAGTTYAFNKDASVDVGVSYMHGQSVKINEGPYQFESEGKAWLFGTNFNYAF

SEQ ID NO: 847 - protein, 898 aa, Escherichia coli
MFKEIFTRLIRHLPSRLVHRDPLPGAQQTVNTVVPPSLSAHCLKMAVMPEEELWKTFDTHPEGLNQAEVESAREQHGENKLPAQQPSPWWVHLWVCYRNPFNILLTILGAISYATEDLFAAGVIALMVAISTLLNFIQEARSTKAADALKAMVSNTATVLRVINDKGENGWLEIPIDQLVPGDIIKLAAGDMIPADLRILQARDLFVAQASLTGESLPVEKAATTRQPEHSNPLECDTLCFMGTTVVSGTAQAMVIATGANTWFGQLAGRVSEQESEPNAFQQGISRVSMLLIRFMLVMAPVVLLINGYTKGDWWEAALFALSVAVGLTPEMLPMIVTSTLARGAVKLSKQKVIVKHLDAIQNFGAMDILCTDKTGTLTQDKIVLENHTDISGKTSERVLHSAWLNSHYQTGLKNLLDTAVLEGTDEESARSLASRWQKIDEIPFDFERRRMSVVVAENTEHHQLVCKGALQEILNVCSQVRHNGEIVPLDDIMLRKIKRVTDTLNRQGLRVVAVATKYLPAREGDYQRADESDLILEGYIAFLDPPKETTAPALKALKASGITVKILTGDSELVAAKVCHEVGLDAGEVVIGSDIETLSDDELANLAQRTTLFARLTPMHKERIVTLLKREGHVVGFMGDGINDAPALRAADIGISVDGAVDIAREAADIILLEKSLMVLEEGVIEGRRTFANMLKYIKMTASSNFGNVFSVLVASAFLPFLPMLPLHLLIQNLLYDVSQVAIPFDNVDDEQIQKPQRWNPADLGRFMIFFGPISSIFDILTFCLMWWVFHANTPETQTLFQSGWFVVGLLSQTLIVHMIRTRRVPFIQSCASWPLMIMTVIVMIVGIALPFSPLASYLQLQALPLSYFPWLVAILAGYMTLTQLVKGFYSRRYGWQ

SEQ ID NO: 848 - protein, 97 aa, Escherichia coli
MSESLSWMQTGDTLALSGELDQDVLLPLWEMREEAVKGITCIDLSRVSRVDTGGLALLLHLIDLAKKQGNNVTLQGVNDKVYTLAKLYNLPADVLPR

SEQ ID NO: 849 - protein, 260 aa, Escherichia coli
MLLNALASLGHKGIKTLRTFGRAGLMLFNALVGKPEFRKHAPLLVRQLYNVGVLSMLIIVVSGVFIGMVLGLQGYLVLTTYSAETSLGMLVALSLLRELGPVVAALLFAGRAGSALTAEIGLMRATEQLSSMEMMAVDPLRRVISPRFWAGVISLPLLTVIFVAVGIWGGSLVGVSWKGIDSGFFWSAMQNAVDWRMDLVNCLIKSVVFAITVTWISLFNGYDAIPTSAGISRATTRTVVHSSLAVLGLDFVLTALMFGN

SEQ ID NO: 850 - protein, 129 aa, Escherichia coli
MKRYLRWIVAAEFLFAAGNLHAVEVEVPGLLTDHTVSSIGHDFYRAFSDKWESDYTGNLTINERPSARWGSWITITVNQDVIFQTFLFPLKRDFEKTVVFALIQTEEALNRRQINQALLSTGDLAHDEF

SEQ ID NO: 851 - protein, 243 aa, Escherichia coli
MKKVLIAALIAGFSLSATAAETIRFATEASYPPFESIDANNQIVGFDVDLAQALCKEIDATCTFSNQAFDSLIPSLKFRRVEAVMAGMDITPEREKQVLFTTPYYDNSALFVGQQGKYTSVDQLKGKKVGVQNGTTHQKFIMDKHPEITTVPYDSYQNAKLDLQNGRIDGVFGDTAVVTEWLKDNPKLAAVGDKVTDKDYFGTGLGIAVRQGNTELQQKLNTALEKVKKDGTYETIYNKWFQK

SEQ ID NO: 852 - protein, 249 aa, Escherichia coli
MSIVMQLQDVAESTRLGPLSGEVRAGEILHLVGPNGAGKSTLLARMAGMTSGKGSIQFAGQPLEAWSATKLALHRAYLSQQQTPPFATPVWHYLTLHQHDKTRTELLNDVAGALALDDKLGRSTNQLSGGEWQRVRLAAVVLQITPQANPAGQLLLLDEPMNSLDVAQQSALDKILSALCQQGLAIVMSSHDLNHTLRHAHRAWLLKGGKMLASGRREEVLTPPNLAQAYGMNFRRLDIEGHRMLISTI

SEQ ID NO: 853 - protein, 139 aa, Escherichia coli
MAMTYHLDVVSAEQQMFSGLVEKIQVTGSEGELGIYPGHAPLLTAIKPGMIRIVKQHGHEEFIYLSGGILEVQPGNVTVLADTAIRGQDLDEARAMEAKRKAEEHISSSHGDVDYAQASAELAKAIAQLRVIELTKKAM

SEQ ID NO: 854 - protein, 663 aa, Escherichia coli
MFRLNPFVRVGLCLSAISCAWPVLAVDDDGETMVVTASSVEQNLKDAPASISVITQEDLQRKPVQNLKDVLKEVPGVQLTNEGDNRKGVSIRGLDSSYTLILVDGKRVNSRNAVFRHNDFDLNWIPVDSIERIEVVRGPMSSLYGSDALGGVVNIITKKIGQKWSGTVTVDTTIQEHRDRGDTYNGQFFTSGPLIDGVLGMKAYGSLAKREKDDPQNSTTTDTGETPRIEGFSSRDGNVEFAWTPNQNHDFTAGYGFDRQDRDSDSLDKNRLERQNYSVSHNGRWDYGTSELKYYGEKVENKNPGNSSPITSESNTVDGKYTLPLTAINQFLTVGGEWRHDKLSDAVNLTGGTSSKTSASQYALFVEDEWRIFEPLALTTGVRMDDHETYGEHWSPRAYLVYNATDTVTVKGGWATAFKAPSLLQLSPDWTSNSCRGACKIVGSPDLKPETSESWELGLYYMGEEGWLEGVESSVTVFRNDVKDRISISRTSDVNAAPGYQNFVGFETGANGRRIPVFSYYNVNKARIQGVETELKIPFNDEWKLSINYTYNDGRDVSNGENKPLSDLPFHTANGTLDWKPLALEDWSFYVSGHYTGQKRADSATAKTPGGYTIWNTGAAWQVTKDVKLRAGVLNLGDKDLSRDDYSYNEDGRRYFMAVDYRF

SEQ ID NO: 855 - protein, 331 aa, Escherichia coli
MINEATLAESIRRLRQGERATLAQAMTLVESRHPRHQALSTQLLDAIMPYCGNTLRLGVTGTPGAGKSTFLEAFGMLLIREGLKVAVIAVDPSSPVTGGSILGDKTRMNDLARAEAAFIRPVPSSGHLGGASQRARELMLLCEAAGYDVVIVETVGVGQSETEVARMVDCFISLQIAGGGDDLQGIKKGLMEVADLIVINKDDGDNHTNVAIARHMYESALHILRRKYDEWQPRVLTCSALEKRGIDEIWHAIIDFKTALTASGRLQQVRQQQSVEWLRKQTEEEVLNHLFANEDFDRYYRQTLLAVKNNTLSPRTGLRQLSEFIQTQYFD

SEQ ID NO: 856 - protein, 277 aa, Escherichia coli
MQRLFLLVAVMLLSGCLTAPPKEAARPTLMPRAQSYKDLTHLPAPTGKIFVSVYNIQDETGQFKPYPASNFSTAVPQSATAMLVTALKDSRWFIPLERQGLQNLLNERKIIRAAQENGTVAINNRIPLQSLTAANIMVEGSIIGYESNVKSGGVGARYFGIGADTQYQLDQIAVNLRVVNVSTGEILSSVNTSKTILSYEVQAGVFRFIDYQRLLEGEVGYTSNEPVMLCLMSAIETGVIFLINDGIDRGLWDLQNKAERQNDILVKYRHMSVPPES

SEQ ID NO: 857 - protein, 484 aa, Escherichia coli
MEHQRKLFQQRGYSEDLLPKTQSQRTWKTFNYFTLWMGSVHNVPNYVMVGGFFILGLSTFSIMLAIILSAFFIAAVMVLNGAAGSKYGVPFAMILRASYGVRGALFPGLLRGGIAAIMWFGLQCYAGSLACLILIGKIWPGFLTLGGDFTLLGLSLPGLITFLIFWLVNVGIGFGGGKVLNKFTAILNPCIYIVFGGMAIWAISLVGIGPIFDYIPSGIQKAENGGFLFLVVINAVVAVWAAPAVSASDFTQNAHSFREQALGQTLGLVVAYILFAVAGVCIIAGASIHYGADTWNVLDIVQRWDSLFASFFAVLVILMTTISTNATGNIIPAGYQIAAIAPTKLTYKNGVLIASIISLLICPWKLMENQDSIYLFLDIIGGMLGPVIGVMMAHYFVVMRGQINLDELYTAPGDYKYYDNGFNLTAFSVTLVAVILSLGGKFIHFMEPLSRVSWFVGVIVAFAAYALLKKRTTAEKTGEQKTIG

SEQ ID NO: 858 - protein, 504 aa, Escherichia coli
MQQSTPYLSFRGIGKTFPGVKALTDISFDCYAGQVHALMGENGAGKSTLLKILSGNYAPTTGSVVINGQEMSFSDTTAALNAGVAIIYQELHLVPEMTVAENIYLGQLPHKGGIVNRSLLNYEAGLQLKHLGMDIDPDTPLKYLSIGQWQMVEIAKALARNAKIIAFDEPTSSLSAREIDNLFRVIRELRKEGRVILYVSHRMEEIFALSDAITVFKDGRYVKTFTDMQQVDHDALVQAMVGRDIGDIYGWQPRSYGEERLRLDAVKAPGVRTPISLAVRSGEIVGLFGLVGAGRSELMKGMFGGTQITAGQVYIDQQPIDIRKPSHAIAAGMMLCPEDRKAEGIIPVHSVRDNINISARRKHVLGGCVINNGWEENNADHHIRSLNIKTPGAEQLIMNLSGGNQQKAILGRWLSEEMKVILLDEPTRGIDVGAKHEIYNVIYALAAQGVAVLFASSDLPEVLGVADRIVVMREGEIAGELLHEQADERQALSLAMPKVSQAVA

SEQ ID NO: 859 - protein, 460 aa, Escherichia coli
MEKKLGLSALTALVLSSMLGAGVFSLPQNMAAVASPAALLIGWGITGAGILLLAFAMLILTRIRPELDGGIFTYAREGFGELIGFCSAWGYWLCAVIANVSYLVIVFSALSFFTDTPELRLFGDGNTWQSIVGASALLWIVHFLILRGVQTAASINLVATLAKLLPLGLFVVLAMMMFKLDTFKLDFTGLALGVPVWEQVKNTMLITLWVFIGVEGAVVVSARARNKRDVGKATLLAVLSALGVYLLVTLLSLGVVARPELAEIRNPSMAGLMVEMMGPWGEIIIAAGLIVSVCGAYLSWTIMAAEVPFLAATHKAFPRIFARQNAQAAPSASLWLTNICVQICLVLIWLTGSDYNTLLTIASEMILVPYFLVGAFLLKIATRPLHKAVGVGACIYGLWLLYASGPMHLLLSVVLYAPGLLVFLYARKTHTHDNVLNRQEMVLIGMLLIASVPATWMLVG

SEQ ID NO: 860 - protein, 1049 aa, Escherichia coli [sequence omitted]

SEQ ID NO: 861 - protein, 331 aa, Escherichia coli
MKQTVYIASPESQQIHVWNLNHEGALTLTQVVDVPGQVQPMVVSPDKRYLYVGVRPEFRVLAYRIAPDDGALTFAAESALPGSPTHISTDHQGQFVFVGSYNAGNVSVTRLEDGLPVGVVDVVEGLDGCHSANISPDNRTLWVPALKQDRICLFTVSDDGHLVAQDPAEVTTVEGAGPRHMVFHPNEQYAYCVNELNSSVDVWELKDPHGNIECVQTLDMMPENFSDTRWAADIHITPDGRHLYACDRTASLITVFSVSEDGSVLSKEGFQPTETQPRGFNVDHSGKYLIAAGQKSHHISVYEIVGEQGLLHEKGRYAVGQGPMWVVVNAH

SEQ ID NO: 862 - protein, 242 aa, Escherichia coli
MSIQLNGINCFYGAHQALFDITLDCPQGETLVLLGPSGAGKSSLLRVLNLLEMPRSGTLNIAGNHFDFTKTPSDKAIRDLRRNVGMVFQQYNLWPHLTVQQNLIEAPCRVLGLSKDQALARAEKLLERLRLKPYSDRYPLHLSGGQQQRVAIARALMMEPQVLLFDEPTAALDPEITAQIVSIIRELAETNITQVIVTHEVEVARKTASRVVYMENGHIVEQGDASCFTEPQTEAFKNYLSH

SEQ ID NO: 863 - protein, 810 aa, Escherichia coli
MAMKKLLIASLLFSSATVYGAEGFVVKDIHFEGLQRVAVGAALLSMPVRTGDTVNDEDISNTIRALFATGNFEDVRVLRDGDTLLVQVKERPTIASITFSGNKSVKDDMLKQNLEASGVRVGESLDRTTIADIEKGLEDFYYSVGKYSASVKAVVTPLPRNRVDLKLVFQEGVSAEIQQINIVGNHAFTTDELISHFQLRDEVPWWNVVGDRKYQKQKLAGDLETLRSYYLDRGYARFNIDSTQVSLTPDKKGIYVTVNITEGDQYKLSGVEVSGNLAGHSAEIEQLTKIEPGELYNGTKVTKMEDDIKKLLGRYGYAYPRVQSMPEINDADKTVKLRVNVDAGNRFYVRKIRFEGNDTSKDAVLRREMRQMEGAWLGSDLVDQGKERLNRLGFFETVDTDTQRVPGSPDQVDVVYKVKERNTGSFNFGIGYGTESGVSFQAGVQQDNWLGTGYAVGINGTKNDYQTYAELSVTNPYFTVDGVSLGGRLFYNDFQADDADLSDYTNKSYGTDVTLGFPINEYNSLRAGLGYVHNSLSNMQPQVAMWRYLYSMGEHPSTSDQDNSFKTDDFTFNYGWTYNKLDRGYFPTDGSRVNLTGKVTIPGSDNEYYKVTLDTATYVPIDDDHKWVVLGRTRWGYGDGLGGKEMPFYENFYAGGSSTVRGFQSNTIGPKAVYFPHQASNYDPDYDYECATQDGAKDLCKSDDAVGGNAMAVASLEFITPTPFISDKYANSVRTSFFWDMGTVWDTNWDSSQYSGYPDYSDPSNIRMSAGIALQWMSPLGPLVFSYAQPFKKYDGDKAEQFQFNIGKTW

SEQ ID NO: 864 - protein, 299 aa, Escherichia coli
MALLIITTILWAFSFSFYGEYLAGHVDSYFAVLVRVGLAALVFLPFLRTRGNSLKTVGLYMLVGAMQLGVMYMLSFRAYLYLTVSELLLFTVLTPLYITLIYDIMSKRRLRWGYAFSALLAVIGAGIIRYDQVTDHFWTGLLLVQLSNITFAIGMVGYKRLMETRPMPQHNAFAWFYLGAFLVAVIAWFLLGNAQKMPQTTLQWGILVFLGVVASGIGYFMWNYGATQVDAGTLGIMNNMHVPAGLLVNLAIWHQQPHWPTFITGALVILASLWVHRKWVAPRSSQTADDRRRDCALSE

SEQ ID NO: 865 - protein, 429 aa, Escherichia coli
MLLAGAIFVLTIVLVIWQPKGLGIGWSATLGAVLALVTGVVHPGDIPVVWNIVWNATAAFIAVIIISLLLDESGFFEWAALHVSRWGNGRGRLLFTWIVLLGAAVAALFANDGAALILTPIVIAMLLALGFSKGTTLAFVMAAGFIADTASLPLIVSNLVNIVSADFFGLGFREYASVMVPVDIAAIVATLVMLHLYFRKDIPQNYDMALLKSPAEAIKDPATFKTGWVVLLLLLVGFFVLEPLGIPVSAIAAVGALILFVVAKRGHAINTGKVLRGAPWQIVIFSLGMYLVVYGLRNAGLTEYLSGVLNVLADNGLWAATLGTGFLTAFLSSIMNNMPTVLVGALSIDGSTASGVIKEAMVYANVIGCDLGPKITPIGSLATLLWLHVLSQKNMTISWGYYFRTGIIMTLPVLFVTLAALALRLSFTL

SEQ ID NO: 866 - protein, 176 aa, Escherichia coli
MNRFSKTQIYLHWITLLFVAITYAAMELRGWFPKGSSTYLLMRETHYNAGIFVWVLMFSRLIIKHRYSDPSIVPPPPAWQMKAASLMHIMLYITFLALPLLGIALMAYSGKSWSFLGFNVSPFVTPNSEIKALIKNIHETWANIGYFLIAAHAGAALFHHYIQKDNTLLRMMPRRK

SEQ ID NO: 867 - protein, 549 aa, Escherichia coli
MKRVLTALAATLPFAANAADAISGAVERQPTNWQAIIMFLIFVVFTLGITYWASKRVRSRSDYYTAGGNITGFQNGLAIAGDYMSAASFLGISALVFTSGYDGLIYSLGFLVGWPIILFLIAERLRNLGRYTFADVASYRLKQGPIRILSACGSLVVVALYLIAQMVGAGKLIELLFGLNYHIAVVLVGVLMMMYVLFGGMLATTWVQIIKAVLLLFGASFMAFMVMKHVGFSFNNLFSEAMAVHPKGVDIMKPGGLVKDPISALSLGLGLMFGTAGLPHILMRFFTVSDAREARKSVFYATGFMGYFYILTFIIGFGAIMLVGANPEYKDAAGHLIGGNNMAAVHLANAVGGNLFLGFISAVAFATILAVVAGLTLAGASAVSHDLYANVFKKGATEREELRVSKITVLILGVIAIILGVLFENQNIAFMVGLAFAIAASCNFPIILLSMYWSKLTTRGAMMGGWLGLITAVVLMILGPTIWVQILGHEKAIFPYEYPALFSITVAFLGIWFFSATDNSAEGARERELFRAQFIRSQTGFGVEQGRAH

SEQ ID NO: 868 - protein, 473 aa, Escherichia coli
MKTDTPSLETPQAARLRRRQLIRQLLERDKTPLAILFMAAVVGTLVGLAAVAFDKGVAWLQNQRMGALVHTADNYPLLLTVAFLCSAVLAMFGYFLVRKYAPEAGGSGIPEIEGALEDQRPVRWWRVLPVKFFGGLGTLGGGMVLGREGPTVQIGGNIGRMVLDIFRLKGDEARHTLLATGAAAGLAAAFNAPLAGILFIIEEMRPQFRYTLISIKAVFIGVIMSTIMYRIFNHEVALIDVGKLSDAPLNTLWLYLILGIIFGIFGPIFNKWVLGMQDLLHRVHGGNITKWVLMGGAIGGLCGLLGFVAPATSGGGFNLIPIATAGNFSMGMLVFIFVARVITTLLCFSSGAPGGIFAPMLALGTVLGTAFGMVAVELFPQYHLEAGTFAIAGMGALLAASIRAPLTGIILVLEMTDNYQLILPMIITGLGATLLAQFTGGKPLYSAILARTLAKQEAEQLARSKAASASENT

SEQ ID NO: 869 - protein, 326 aa, Escherichia coli
MGFTTRVKSEASEKKPFNFALFWDKYGTFFILAIIVAIFGSLSPEYFLTTNNITQIFVQSSVTVLIGMGEFFAILVAGIDLSVGAILALSGMVTAKLMLAGVDPFLAAMIGGVLVGGALGAINGCLVNWTGLHPFIITLGTNAIFRGITLVISDANSVYGFSFDFVNFFAASVIGIPVPVIFSLIVALILWFLTTRMRLGRNIYALGGNKNSAFYSGIDVKFHILVVFIISGVCAGLAGVVSTARLGAAEPLAGMGFETYAIASAIIGGTSFFGGKGRIFSVVIGGLIIGTINNGLNILQVQTYYQLVVMGGLIIAAVALDRLISK

SEQ ID NO: 870 - protein, 510 aa, Escherichia coli
MATPYISMAGIGKSFGPVHALKSVNLTVYPGEIHALLGENGAGKSTLMKVLSGIHEPTKGTITINNISYNKLDHKLAAQLGIGIIYQELSVIDELTVLENLYIGRHLTKKICGVNIIDWREMRVRAAMMLLRVGLKVDLDEKVANLSISHKQMLEIAKTLMLDAKVIIMDEPTSSLTNKEVDYLFLIMNQLRKEGTAIVYISHKLAEIRRICDRYTVMKDGSSVCSGIVSDVSNDDIVRLMVGRELQNRFNAMKENVSNLAHETVFEVRNVTSRDRKKVRDISFSVCRGEILGFAGLVGSGRTELMNCLFGVDKRAGGEIRLNGKDISPRSPLDAVKKGMAYITESRRDNGFFPNFSIAQNMAISRSLKDGGYKGAMGLFHEVDEQRTAENQRELLALKCHSVNQNITELSGGNQQKVLISKWLCCCPEVIIFDEPTRGIDVGAKAEIYKVMRQLADDGKVILMVSSELPEIITVCDRIAVFCEGRLTQILTNRDDMSEEEIMAWALPQE

SEQ ID NO: 871 - protein, 263 aa, Escherichia coli
MSSNFRHQLLSLSLLVGIAAPWAAFAQAPISSVGSGSVEDRVTQLERISNAHSQLLTQLQQQLSDNQSDIDSLRGQIQENQYQLNQVVERQKQILLQIDSLSSGGAAAQSTSGDQSGAAASTTPTADAGTANAGAPVKSGNANTDYNAAIALVQDKSRQDDAMVAFQNFIKNYPDSTYLPNANYWLGQLNYNKGKKDDAAYYFASVVKNYPKSPKAADAMFKVGVIMQDKGDTAKAKAVYQQVISKYPGTDGAKQAQKRLNAM

SEQ ID NO: 872 - protein, 491 aa, Escherichia coli
MSSQYLRIFQQPRSAILLILGFASGLPLALTSGTLQAWMTVENIDLKTIGFFSLVGQAYVFKFLWSPLMDRYTPPFFGRRRGWLLATQILLLVAIAAMGFLEPGTQLRWMAALAVVIAFCSASQDIVFDAWKTDVLPAEERGAGAAISVLGYRLGMLVSGGLALWLADKWLGWQGMYWLMAALLIPCIIATLLAPEPTDTIPVPKTLEQAVVAPLRDFFGRNNAWLILLLIVLYKLGDAFAMSLTTTFLIRGVGFDAGEVGVVNKTLGLLATIVGALYGGILMQRLSLFRALLIFGILQGASNAGYWLLSITDKHLYSMGAAVFFENLCGGMGTSAFVALLMTLCNKSFSATQFALLSALSAVGRVYVGPVAGWFVEAHGWSTFYLFSVAAAVPGLILLLVCRQTLEYTRVNDNFISRTAYPAGYAFAMWTLAAGVSLLAVWLLLLTMDALDLTHFSFLPALLEVGVLVALSGVVLGGLLDYLALRKTHLT

SEQ ID NO: 873 - protein, 677 aa, Escherichia coli
MTDLSHSREKDKINPVVFYTSAGLILLFSLTTILFRDFSALWIGRTLDWVSKTFGWYYLLAATLYIVFVVCIACSRFGSVKLGPEQSKPEFSLLSWAAMLFAAGIGIDLMFFSVAEPVTQYMQPPEGAGQTIEAARQAMVWTLFHYGLTGWSMYALMGMALGYFSYRYNLPLTIRSALYPIFGKRINGPIGHSVDIAAVIGTIFGIATTLGIGVVQLNYGLSVLFDIPDSMAAKAALIALSVIIATISVTSGVDKGIRVLSELNVALALGLILFVLFMGDTSFLLNALVLNVGDYVNRFMGMTLNSFAFDRPVEWMNNWTLFFWAWWVAWSPFVGLFLARISRGRTIRQFVLGTLIIPFTFTLLWLSVFGNSALYEIIHGGAAFAEEAMVHPERGFYSLLAQYPAFTFSASVATITGLLFYVTSADSGALVLGNFTSQLKDINSDAPGWLRVFWSVAIGLLTLGMLMTNGISALQNTTVIMGLPFSFVIFFVMAGLYKSLKVEDYRRESANRDTAPRPLGLQDRLSWKKRLSRLMNYPGTRYTKQMMETVCYPAMEEVAQELRLRGAYVELKSLPPEEGQQLGHLDLLVHMGEEQNFVYQIWPQQYSVPGFTYRARSGKSTYYRLETFLLEGSQGNDLMDYSKEQVITDILDQYERHLNFIHLHREAPGHSVMFPDA

SEQ ID NO: 874 - protein, 271 aa, Escherichia coli
MASENMTPQDYIGHHLNNLQLDLRTFSLVDPQNPPATFWTINIDSMFFSVVLGLLFLVLFRSVAKKATSGVPGKFQTAIELVIGFVNGSVKDMYHGKSKLIAPLALTIFVWVFLMNLMDLLPIDLLPYIAEHVLGLPALRVVPSADVNVTLSMALGVFILILFYSIKMKGIGGFTKELTLQPFNHWAFIPVNLILEGVSLLSKPVSLGLRLFGNMYAGELIFILIAGLLPWWSQWILNVPWAIFHILIITLQAFIFMVLTIVYLSMASEEH

SEQ ID NO: 875 - protein, 243 aa, Escherichia coli
MKKLVLAALLASFTFGASAAEKINFGVSATYPPFESIGANNEIVGFDIDLAKALCKQMQAECTFTNHAFDSLIPSLKFRKYDAVISGMDITPERSKQVSFTTPYYENSAVVIAKKDTYKTFADLKGKRIGMENGTTHQKYIQDQHPEVKTVSYDSYQNAFIDLKNGRIDGVFGDTAVVNEWLKTNPQLGVATEKVTDPQYFGTGLGIAVRPDNKALLEKLNNALAAIKADGTYQKISDQWFPQ

SEQ ID NO: 876 - protein, 222 aa, Escherichia coli
MFEYLPELMKGLHTSLTLTVASLIVALILALIFTIILTLKTPVLVWLVRGYITLFTGTPLLVQIFLIYYGPGQFPTLQEYPALWHLLSEPWLCALIALSLNSAAYTTQLFYGAIRAIPEGQWQSCSALGMSKKDTLAILLPYAFKRSLSSYSNEVVLVFKSTSLAYTITLMEVMGYSQLLYGRTYDVMVFGAAGIIYLVVNGLLTLMMRLIERKALAFERRN

SEQ ID NO: 877 - protein, 176 aa, Escherichia coli
MENKYSRLQISIHWLVFLLVIAAYCAMEFRGFFPRSDRPLINMIHVSCGISILVLMVVRLLLRLKYPTPPIIPKPKPMMTGLAHLGHLVIYLLFIALPVIGLVMMYNRGNPWFAFGLTMPYASEANFERVDSLKSWHETLANLGYFVIGLHAAAALAHHYFWKDNTLLRMMPRKRS

SEQ ID NO: 878 - protein, 418 aa, Escherichia coli
MFHRLLIATVVGILAAFAVAGFRHAMLLLEWLFLNNDSGSLVNAATNLSPWRRLLTPALGGLAAGLLLMGWQKFTQQRPHAPTDYMEALQTDGQFDYAASLVKSLASLLVVTSGSAIGREGAMILLAALAASCFAQRFTPRQEWKLWIACGAAAGMAAAYRAPLAGSLFIAEVLFGTMMLASLGPVIISAVVALLVSNLINHSDALLYNVQLSVTVQARDYALIISTGVLAGLCGPLLLTLMNACHRGFVSLKLAPPWQLALGGLIVGLLSLFTPAVWGNGYSTVQSFLTAPPLLMIIAGIFLCKLCAVLASSGSGAPGGVFTPTLFIGLAIGMLYGRSLGLWFPDGEEITLLLGLTGMATLLAATTHAPIMSTLMICEMTGEYQLLPGLLIACVIASVISRTLHRDSIYRQHTAQHS

SEQ ID NO: 879 - protein, 1039 aa, Escherichia coli
MKRHLNTCYRLVWNHMTGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 880 - protein, 138 aa, Escherichia coli
MRVKHAVVLLMLISPLSWAGTMTFQFRNPNFGGNPNNGAFLLNSAQAQNSYKDPSYNDDFGIETPSALDNFTQAIQSQILGGLLSNINTGKPGRMVTNDYIVDIANRDGQLQLNVTDRKTGQTSTIQVSGLQNNSTDF

SEQ ID NO: 881 - protein, 397 aa, Escherichia coli
MNKNRGFTPLAVVLMLSGSLALTGCDDKQAQQGGQQMPAVGVVTVKTEPLQITTELPGRTSAYRIAEVRPQVSGIILKRNFKEGSDIEAGVSLYQIDPATYQATYDSAKGDLAKAQAAANIAQLTVNRYQKLLGTQYISKQEYDQALADAQQANAAVTAAKAAVETARINLAYTKVTSPISGRIGKSNVTEGALVQNGQATALATVQQLDPIYVDVTQSSNDFLRLKQELANGTLKQENGKAKVSLITSDGIKFPQDGTLEFSDVTVDQTTGSITLRAIFPNPDHTLLPGMFVRARLEEGLNPNAILVPQQGVTRTPRGDATVLVVGADDKVETRPIVASQAIGDKWLVTEGLKAGDRVVISGLQKVRPGVQVKAQEVTADNNQQAASGAQPEQSKS

SEQ ID NO: 882 - protein, 64 aa, Escherichia coli
MYVCLCNGISDKKIRQAVRQFSPHSFQQLKKFIPVGNQCGKCVRAAREVMEDELMQLPEFKESA

SEQ ID NO: 883 - protein, 504 aa, Escherichia coli
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFHWGPLPWATYSFLSVAFAYFFFVRKMEVIRPSSTLVPLVGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVLGLTASTWILWTVLGSNTLLLIDKNIINIPNLIEQYGVARAIIETWAALPLSTATMWGFFILCFIATVTLVNACSYTLAMSTCREVRDGEEPPLLVRIGWSILVGIIGIVLLALGGLKPIQTAIIAGGCPLFFVNIMVTLSFIKDAKQNWKD

SEQ ID NO: 884 - protein, 311 aa, Escherichia coli
MNKYLKYFSGTLVGLMLSTSAFAAAEYAVVLKTLSNPFWVDMKKGIEDEAKTLGVSVDIFASPSEGDFQSQLQLFEDLSNKNYKGIAFAPLSSVNLVMPVARAWKKGIYLVNLDEKIDMDNLKKAGGNVEAFVTTDNVAVGAKGASFIIDKLGAEGGEVAIIEGKAGNASGEARRNGATEAFKKASQIKLVASQPADWDRIKALDVATNVLQRNPNIKAIYCANDTMAMGVAQAVANAGKTGKVLVVGTDGIPEARKMVEAGQMTATVAQNPADIGATGLKLMVDAEKSGKVIPLDKAPEFKLVDSILVTQ

SEQ ID NO: 885 - protein, 289 aa, Escherichia coli
MSTFKPLKTLTSRRQVLKAGLAALTLSGMSQAIAKDELLKTSNGHSKPKAKKSGGKRVVVLDPGHGGIDTGAIGRNGSKEKHVVLAIAKNVRSILRNHGIDARLTRSGDTFIPLYDRVEIAHKHGADLFMSIHADGFTNPKAAGASVFALSNRGASSAMAKYLSERENRADEVAGKKATDKDHLLQQVLFDLVQTDTIKNSLTLGSHILKKIKPVHKLHSRNTEQAAFVVLKSPSVPSVLVETSFITNPEEERLLGTAAFRQKIATAIAEGVISYFHWFDNQKAHSKKR

SEQ ID NO: 886 - protein, 287 aa, Escherichia coli
MAGAKEIRSKIASVQNTQKITKAMEMVAASKMRKSQDRMAASRPYAETMRKVIGHLAHGNLEYKHPYLEDRDVKRVGYLVVSTDRGLCGGLNINLFKKLLAEMKTWTDKGVQCDLAMIGSKGVSFFNSVGGNVVAQVTGMGDNPSLSELIGPVKVMLQAYDEGRLDKLYIVSNKFINTMSQVPTISQLLPLPASDDDDLKHKSWDYLYEPDPKALLDTLLRRYVESQVYQGVVENLASEQAARMVAMKAATDNGGSLIKELQLVYNKARQASITQELTEIVSGAAAV

SEQ ID NO: 887 - protein, 158 aa, Escherichia coli
MKGDTKVINYLNKLLGNELVAINQYFLHARMFKNWGLKRLNDVEYHESIDEMKHADRYIERILFLEGLPNLQDLGKLNIGEDVEEMLRSDLALELDGAKNLREAIGYADSVHDYVSRDMMIEILRDEEGHIDWLETELDLIQKMGLQNYLQAQIREEG

SEQ ID NO: 888 - protein, 655 aa, Escherichia coli
MGIFSIANQHIRFAVKLATAIVLALFVGFHFQLETPRWAVLTAAIVAAGTAFAAGGEPYSGAIRYRGFLRIIGTFIGCIAGLVIIIAMIRAPLLMILVCCIWAGFCTWISSLVRIENSYAWGLAGYTALIIVITIQPEPLLTPQFAVERCSEIVIGIVCAIMADLLFSPRSIKQEVDRELESLLVAQYQLMQLCIKHGDGEVVDKAWGDLVRRTTALQGMRSNLNMESSRWARANRRLKAINTLSLTLITQSCETYLIQNTRPELITDTFREFFDTPVETAQDVHKQLKRLRRVIAWTGERETPVTIYSWVAAATRYQLLKRGVISNTKINATEEEILQGEPEVKVESAERHHAMVNFWRTTLSCILGTLFWLWTGWTSGSGAMVMIAVVTSLAMRLPNPRMVAIDFIYGTLAALPLGLLYFLVIIPNTQQSMLLLCISLAVLGFFLGIEVQKRRLGSMGALASTINIIVLDNPMTFHFSQFLDSALGQIVGCVLAFTVILLVRDKSRDRTGRVLLNQFVSAAVSAMTTNVARRKENHLPALYQQLFLLMNKFPGDLPKFRLALTMIIAHQRLRDAPIPVNEDLSAFHRQMRRTADHVISARSDDKRRRYFGQLLEELEIYQEKLRIWQAPPQVTEPVNRLAGMLHKYQHALTDS

SEQ ID NO: 889 - protein, 499 aa, Escherichia coli
MSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 890 - protein, 460 aa, Escherichia coli
MATGKIVQVIGAVVDVEFPQDAVPRVYDALEVQNGNERLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDIIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 891 - protein, 468 aa, Escherichia coli
MRTFSGKRSTLALAIAGVTAMSGFMAMPEARAEGFIDDSTLTGGIYYWQRERDRKDVTDGDKYKTNLSHSTWNANLDFQSGYAADMFGLDIAAFTAIEMAENGDSSHPNEIAFSKSNKAYDEDWSGDKSGISLYKAAAKFKYGPVWARAGYIQPTGQTLLAPHWSFMPGTYQGAEAGANFDYGDAGALSFSYMWTNEYKAPWHLEMDEFYQNDKTTKVDYLHSFGAKYDFKNNFVLEAAFGQAEGYIDQYFAKASYKFDIAGSPLTTSYQFYGTRDKVDDRSVNDLYDGTAWLQALTFGYRAADVVDLRLEGTWVKADGQQGYFLQRMTPTYASSNGRLDIWWDNRSDFNANGEKAVFFGAMYDLKNWNLPGFAIGASYVYAWDAKPATWQSNPDAYYDKNRTIEESAYSLDAVYTIQDGRAKGTMFKLHFTEYDNHSDIPSWGGGYGNIFQDERDVKFMVIAPFTIF

SEQ ID NO: 892 - protein, 1037 aa, Escherichia coli
MANFFIDRPIFAWVLAILLCLTGTLAIFSLPVEQYPDLAPPNVRVTANYPGASAQTLENTVTQVIEQNMTGLDNLMYMSSQSSGTGQASVTLSFKAGTDPDEAVQQVQNQLQSAMRKLPQAVQNQGVTVRKTGDTNILTIAFVSTDGSMDKQDIADYVASNIQDPLSRVNGVGDIDAYGSQYSMRIWLDPAKLNSFQMTAKDVTDAIESQNAQIAVGQLGGTPSVDKQALNATINAQSLLQTPEQFRDITLRVNQDGSEVRLGDVATVEMGAEKYDYLSRFNGKPASGLGVKLASGANEMATAELVLNRLDELAQYFPHGLEYKVAYETTSFVKASIEDVVKTLLEAIALVFLVMYLFLQNFRATLIPTIAVPVVLMGTFSVLYAFGYSVNTLTMFAMVLAIGLLVDDAIVVVENVERIMSEEGLTPREATRKSMGQIQGALVGIAMVLSAVFVPMAFFGGTTGAIYRQFSITIVAAMVLSVLVAMILTPALCATLLKPLKKGEHHGQKGFFAWFNQMFNRNAERYEKGVAKILHRSLRWIVIYVLLLGGMVFLFLRLPTSFLPLEDRGMFTTSVQLPSGSTQQQTLKVVEQIEKYYFTHEKDNIMSVFATVGSGPGGNGQNVARMFIRLKDWSERDSKTGTSFAIIERATKAFNQIKEARVIASSPPAISGLGSSAGFDMELQDHAGAGHDALMAARNQLLALAAENPELTRVRHNGLDDSPQLQIDIDQRKAQALGVAIDDINDTLQTAWGSSYVNDFMDRGRVKKVYVQAAAPYRMLPDDINLWYVRNKDGGMVPFSAFATSRWETGSPRLERYNGYSAVEIVGEAAPGVSTGTAMDIMESLVKQLPNGFGLEWTAMSYQERLSGAQAPALYAISLLVVFLCLAALYESWSVPFSVMLVVPLGVIGALLATWMRGLENDVYFQVGLLTVIGLSAKNAILIVEFANEMNQKGHDLFEATLHACRQRLRPILMTSLAFIFGVLPMATSTGAGSGGQHAVGTGVMGGMISATILAIYFVPLFFVLVRRRFPLKPRPE

SEQ ID NO: 893 - protein, 238 aa, Escherichia coli
MKKAKILSGVLLLCFSSPLISQAATLDVRGGYRSGSHAYETRLKVSEGWQNGWWASMESNTWNTIHDNKKENAALNDVQVEVNYAIKLDDQWTVRPGMLTHFSSNGTRYGPYVKLSWDATKDLNFGIRYRYDWKAYRQQDLSGDMSRDNVHRWDGYVTYHINSDFTFAWQTTLYSKQNDYRYANHKKWATENAFVLQYHMTPDITPYIEYDYLDRQGVYNGRDNLSENSYRIGVSFKL

SEQ ID NO: 894 - protein, 191 aa, Escherichia coli
MIRISDAAQAHFAKLLANQEEGTQIRVFVINPGTPNAECGVSYCPPDAVEATDTALKFDLLTAYVDELSAPYLEDAEIDFVTDQLGSQLTLKAPNAKMRKVADDAPLMERVEYMLQSQINPQLAGHGGRVSLMEITEDGYAILQFGGGCNGCSMVDVTLKEGIEKQLLNEFPELKGVRDLTEHQRGEHSYY

SEQ ID NO: 895 - protein, 238 aa, Escherichia coli
MRLEFSIYRYNPDVDDAPRMQDYTLEADEGRDMMLLDALIQLKEKDPSLSFRRSCREGVCGSDGLNMNGKNGLACITPISALNQPGKKIVIRPLPGLPVIRDLVVDMGQFYAQYEKIKPYLLNNGQNPPAREHLQMPEQREKLDGLYECILCACCSTSCPSFWWNPDKFIGPAGLLAAYRFLIDSRDTETDSRLDGLSDAFSVFRCHSIMNCVSVCPKGLNPTRAIGHIKSMLLQRNA

SEQ ID NO: 896 - protein, 127 aa, Escherichia coli
MSANTEAQGSGRGLEAMKWVVVVALLLVAIVGNYLYRDIMLPLRALAVVILIAAAGGVALLTTKGKATVAFAREARTEVRKVIWPTRQETLHTTLIVAAVTAVMSLILWGLDGILVRLVSFITGLRF

SEQ ID NO: 897 - protein, 147 aa, Escherichia coli
MFNNILVVCVGNICRSPTAERLLQRYHPELKVESAGLGALVGKGADPTAISVAAEHQLSLEGHCARQISRRLCRNYDLILTMEKRHIERLCEMAPEMRGKVMLFGHWDNECEIPDPYRKSRETFAAVYTLLERSARQWAQALNAEQV

SEQ ID NO: 898 - protein, 252 aa, Escherichia coli
MSQILLQPANAMITLENVNKWYGQFHVLKNINLTVQPGERIVLCGPSGSGKSTTIRCINHLEEHQQGRIVVDGIELNEDIRNIERVRQEVGMVFQHFNLFPHLTVLQNCTLAPIWVRKMPKKEAEDLAVHYLERVRIAEHAHKFPGQISGGQQQRVAIARSLCMKPKIMLFDEPTSALDPEMVKEVLDTMIGLAQSGMTMLCVTHEMGFARTVADRVIFMDRGEIVEQAAPDEFFAHPKSERTRAFLSQVIH

SEQ ID NO: 899 - protein, 272 aa, Escherichia coli
MTTRVIALDLDGTLLTPKKTLLPSSIEALARAREAGYQLIIVTGRHHVAIHPFYQALALDTPAICCNGTYLYDYHAKTVLEADPMPVIKALQLIEMLNEHHIHGLMYVDDAMVYEHPTGHVIRTSNWAQTLPPEQRPTFTQVASLAETAQQVNAVWKFALTHDDLPQLQHFGKHVEHELGLECEWSWHDQVDIARGGNSKGKRLTKWVEAQGWSMENVVAFGDNFNDISMLEAAGTGVAMGNADDAVKARANIVIGDNTTDSIAQFIYSHLI

SEQ ID NO: 900 - protein, 416 aa, Escherichia coli
MSLAKASLWTAASTLVKIGAGLLVGKLLAVSFGPAGLGLAANFRQLITVLGVLAGAGIFNGVTKYVAQYHDNPQQLRRVVGTSSAMVLGFSTLMALVFVLAAAPISQGLFGNTDYQGLVRLVALVQMGIAWGNLLLALMKGFRDAAGNALSLIVGSLIGVLAYYVSYRLGGYEGALLGLALIPALVVIPAAIMLIKRGVIPLSYLKPSWDNGLAGQLSKFTLMALITSVTLPVAYIMMRKLLAAQYSWDEVGIWQGVSSISDAYLQFITASFSVYLLPTLSRLTEKRDITREVVKSLKFVLPAVAAASFTVWLLRDFAIWLLLSNKFTAMRDLFAWQLVGDVLKVGAYVFGYLVIAKASLRFYILAEVSQFTLLMVFAHWLIPAHGALGAAQAYMATYIVYFSLCCGVFLLWRRRA

SEQ ID NO: 901 - protein, 433 aa, Escherichia coli
MFNFAVSRESLLSGFQWFFFIFCNTVVVPPTLLSAFQLPQSSLLTLTQYAFLATALACFAQAFCGHRRAIMEGPGGLWWGTILTITLGEASRGTPINDIATSLAVGIALSGVLTMLIGFSGLGHRLARLFTPSVMVLFMLMLGAQLTTIFFKGMLGLPFGIADPNFKIQLPPFALSVAVMCLVLAMIIFLPQRFARYGLLVGTITGWLLWYFCFPSSHSLSGELHWQWFPLGSGGALSPGIILTAVITGLVNISNTYGAIRGTDVFYPQQGAGNTRYRRSFVATGFMTLITVPLAVIPFSPFVSSIGLLTQTGDYTRRSFIYGSVICLLVALVPALTRLFCSIPLPVSSAVMLVSYLPLLFSALVFSQQITFTARNIYRLALPLFVGIFLMALPPVYLQDLPLTLRPLLSNGLLVGILLAVLMDNLIPWERIE

SEQ ID NO: 902 - protein, 463 aa, Escherichia coli
MSVSTLESENAQPVAQTQNSELIYRLEDRPPLPQTLFAACQHLLAMFVAVITPALLICQALGLPAQDTQHIISMSLFASGVASIIQIKAWGPVGSGLLSIQGTSFNFVAPLIMGGTALKTGGADVPTMMAALFGTLMLASCTEMVISRVLHLARRIITPLVSGVVVMIIGLSLIQVGLTSIGGGYAAMSDNTFGAPKNLLLAGVVLALIILLNRQRNPYLRVASLVIAMAAGYALAWFMGMLPESNEPMTQELIMVPTPLYYGLGIEWSLLLPLMLVFMITSLETIGDITATSDVSEQPVSGPLYMKRLKGGVLANGLNSFVSAVFNTFPNSCFGQNNGVIQLTGVASRYVGFVVALMLIVLGLFPAVSGFVQHIPEPVLGGATLVMFGTIAASGVRIVSREPLNRRAILIIALSLAVGLGVSQQPLILQFAPEWLKNLLSSGIAAGGITAIVLNLIFPPEKQ

SEQ ID NO: 903 - protein, 377 aa, Escherichia coli
MSNPILSWRRVRALCVKETRQIVRDPSSWLIAVVIPLLLLFIFGYGINLDSSKLRVGILLEQRSEAALDFTHTMTGSPYIDATISDNRQELIAKMQAGKIRGLVVIPVDFAEQMERANATAPIQVITDGSEPNTANFVQGYVEGIWQIWQMQRAEDNGQTFEPLIDVQTRYWFNPAAISQHFIIPGAVTIIMTVIGAILTSLVVAREWERGTMEALLSTEITRTELLLCKLIPYYFLGMLAMLLCMLVSVFILGVPYRGSLLILFFISSLFLLSTLGMGLLISTITRNQFNAAQVALNAAFLPSIMLSGFIFQIDSMPAVIRAVTYIIPARYFVSTLQSLFLAGNIPVVLVVNVLFLIASAVMFIGLTWLKTKRRLD

SEQ ID NO: 904 - protein, 216 aa, Escherichia coli
MAIRLYKLAVALGVFIVSAPAFSHGHHSHGKPLTEVEQKAANGVFDDANVQNRTLSDWDGVWQSVYPLLQSGKLDPVFQKKADADKTKTFAEIKDYYHKGYATDIEMIGIEDGIVEFHRNNETTSCKYDYDGYKILTYKSGKKGVRYLFECKDPESKAPKYIQFSDHIIAPRKSSHFHIFMGNDSQQSLLNEMENWPTYYPYQLSSEEVVEEMMSH

SEQ ID NO: 905 - protein, 460 aa, Escherichia coli
MTQLTMKDKIGYGLGDTACGFVWQATMFLLAYFYTDVFGLSAGIMGTLFLVSRVLDAVTDPLMGLLVDRTRTRHGQFRPFLLWGAIPFGIVCVLTFYTPDFSAQGKIIYACVTYILLTLVYTFVNVPYCAMPGVITADPKERHALQSWRFFLAAAGSLAISGIALPLVSIIGKGDEQVGYFGAMCVLGLSGVVLLYVCFFTTKERYTFEVQPGSSVAKDLKLLLGNSQWRIMCAFKMMATCSNVVRGGATLYFVKYVMDHPELATQFLLYGSLATMFGSLCSSRLLGRFDRVTAFKWIIVAYSLISLLIFVTPAEHIALIFALNILFLFVFNTTTPLQWLMASDVVDYEESRSGRRLDGLVFSTYLFSLKIGLAIGGAVVGWILAYVNYSASSSVQPVEVLTTIKILFCVVPVVLYAGMFIMLSLYKLTDARVEAISRQLIKHRAAQGEAVPDAATAASH

SEQ ID NO: 906 - protein, 481 aa, Escherichia coli
MVLLAMGLVIYLATSKYGNIRLGEGKPEYSTLSWLFMFICAGLGSSTLYWGVAEWAYYYQTPGLNIAPRSQQALEFSVPYSFFHWGISAWATYTLASLIMAYHFHVRKNKGLSLSGIIAAITGVRPQGPWGKLVDLMFLIATVGALTISLVVTAATFTRGLSALTGLPDNFTVQAFVILLSGGIFCLSSWIGINNGLQRLSKMVGWGAFLLPLLVLIVGPTEFITNSIINAIGLTTQNFLQMSLFTDPLGDGSFTRNWTVFYWLWWISYTPGVAMFVTRVSRGRKIKEVIWGLILGSTVGCWFFFGVMESYAIHQFINGVINVPQVLETLGGETAVQQVLMSLPAGKLFLAAYLGVMIIFLASHMDAVAYTMAATSTRNLQEGDDPDRGLRLFWCVVITLIPLSILFTGASLETMKTTVVLTALPFLVILLVKVGGFIRWLKQDYADIPAHQVEHYLPQTPVEALEKTPVLPAGTVFKGDN

SEQ ID NO: 907 - protein, 280 aa, Escherichia coli
MATNKRTLSRIGFYCGLALFLIITLFPFFVMLMTSFKGAKEAISLHPTLLPQQWTLEHYVDIFNPMIFPFVDYFRNSLVVSVVSSVVAVFLGILGAYALSRLRFKGRMTINASFYTVYMFSGILLVVPLFKIITALGIYDTEMALIITMVTQTLPTAVFMLKSYFDTIPDEIEEAAMMDGLNRLQIIFRITVPLAMSGLISVFVYCFMVAWNDYLFASIFLSSASNFTLPVGLNALFSTPDYIWGRMMAASLVTALPVVIMYALSERFIKSGLTAGGVKG

SEQ ID NO: 908 - protein, 261 aa, Escherichia coli
MIELLFPGWLAGIMLACAAGPLGSFVVWRRMSYFGDTLAHASLLGVAFGLLLDVNPFYAVIAVTLLLAGGLVWLEKRPQLAIDTLLGIMAHSALSLGLVVVSLMSNIRVDLMAYLFGDLLAVTPEDLISIAIGVVIVVAILFWQWRNLLSMTISPDLAFVDGVKLQRVKLLLMLVTALTIGVAMKFVGALIITSLLIIPAATARRFARTPEQMAGVAVLVGMVAVTGGLTFSAVYDTPAGPSVVLCAALLFILSMMKKQAS

SEQ ID NO: 909 - protein, 558 aa, Escherichia coli
MHHATPLITTIVGGLVLAFILGMLANKLRISPLVGYLLAGVLAGPFTPGFVADTKLAPELAELGVILLMFGVGLHFSLKDLMAVKAIAIPGAIAQIAVATLLGMALSAVLGWSLMTGIVFGLCLSTASTVVLLRALEERQLIDSQRGQIAIGWLIVEDLVMVLTLVLLPAVAGMMEQGDVGFATLAVDMGITIGKVIAFIAIMMLVGRRLVPWIMARSAATGSRELFTLSVLALALGVAFGAVELFDVSFALGAFFAGMVLNESELSHRAAHDTLPLRDAFAVLFFVSVGMLFDPLILIQQPLAVLATLAIILFGKSLAAFFLVRLFGHSQRTALTIAASLAQIGEFAFILAGLGMALNLLPQAGQNLVLAGAILSIMLNPVLFALLEKYLAKTETLEEQTLEEAIEEEKQIPVDICNHALLVGYGRVGSLLGEKLLASDIPLVVIETSRTRVDELRERGVRAVLGNAANEEIMQLAHLECAKWLILTIPNGYEAGEIVASARAKNPDIEIIARAHYDDEVAYITERGANQVVMGEREIARTMLELLETPPAGEVVTG

SEQ ID NO: 910 - protein, 314 aa, Escherichia coli
MLTFFIGDLLPIIVIMLLGYFSGRRETFSEDQARAFNKLVLNYALPAALFVSITRANREMIFADTRLTLVSLVVIVGCFFFSWFGCYKFFKRTHAEAAVCALIAGSPTIGFLGFAVLDPIYGDSVSTGLVVAIISIIVNAITIPIGLYLLNPSSGADGKKNSNLSALISAAKEPVVWAPVLATILVLVGVKIPAAWDPTFNLIAKANSGVAVFAAGLTLAAHKFEFSAEIAYNTFLKLILMPLALLLVGMACHLNSEHLQMMVLAGALPPAFSGIIIASRFNVYTRTGTASLAVSVLGFVVTAPLWIYVSRLVS

SEQ ID NO: 911 - protein, 293 aa, Escherichia coli
MNRLFSGRSDMPFALLLLAPSLLLLGGLVAWPMVSNIEISFLRLPLNPNIESTFVGVSNYVRILSDPGFWHSLWMTVWYTALVVAGSTVLGLAVAMFFNREFRLRKTARSLVILSYVTPSISLVFAWKYMFNNGYGIVNYLGVDLLHLYEQAPLWFDNPGSSFVLVVLFAIWRYFPYAFISFLAILQTIDKSLYEAAEMDGANAWQRFRIVTLPAIMPVLATVVTLRTIWMFYMFADVYLLTTKVDILGVYLYKTAFAFNDLGKAAAISVVLFIIIFAVILLTRKRVNLNGNK

SEQ ID NO: 912 - protein, 466 aa, Escherichia coli
MSDINHAGSDLIFELEDRPPFHQALVGAITHLLAIFVPMVTPALIVGAALQLSAETTAYLVSMAMIASGIGTWLQVNRYGIVGSGLLSIQSVNFSFVTVMIALGSSMKSDGFHEELIMSSLLGVSFVGAFLVVGSSFILPYLRRVITPTVSGIVVLMIGLSLIKVGIIDFGGGFAAKSSGTFGNYEHLGVGLLVLIVVIGFNCCRSPLLRMGGIAIGLCVGYIASLCLGMVDFSSMRNLPLITIPHPFKYGFSFSFHQFLVVGTIYLLSVLEAVGDITATAMVSRRPIQGEEYQSRLKGGVLADGLVSVIASAVGSLPLTTFAQNNGVIQMTGVASRYVGRTIAVMLVILGLFPMIGGFFTTIPSAVLGGAMTLMFSMIAIAGIRIIITNGLKRRETLIVATSLGLGLGVSYDPEIFKILPASIYVLVENPICAGGLTAILLNIILPGGYRQENVLPGITSAEEMD

SEQ ID NO: 913 - protein, 321 aa, Escherichia coli
MKQQAGIGILLALTTAICWGALPIAMKQVLEVMEPPTIVFYRFLMASIGLGAILAVKKRLPPLRVFRKPRWLILLAVATAGLFGNFILFSSSLQYLSPTASQVIGQLSPVGMMVASVFILKEKMRSTQVVGALMLLSGLVMFFNTSLVEIFTKLTDYTWGVIFGVGAATVWVSYGVAQKVLLRRLASPQILFLLYTLCTIALFPLAKPGVIAQLSHWQLACLIFCGLNTLVGYGALAEAMARWQAAQVSAIITLTPLFTLFFSDLLSLAWPDFFARPMLNLLGYLGAFVVVAGAMYSAIGHRIWGGLRKHTTVVSQPRAGE

SEQ ID NO: 914 - protein, 318 aa, Escherichia coli
MWKRLLIVSAVSAAMSSMALAAPLTVGFSQVGSESGWRAAETNVAKSEAEKRGITLKIADGQQKQENQIKAVRSFVAQGVDAIFIAPVVATGWEPVLKEAKDAEIPVFLLDRSIDVKDKSLYMTTVTADNILEGKLIGDWLVKEVNGKPCNVVELQGTVGASVAIDRKKGFAEAIKNAPNIKIIRSQSGDFTRSKGKEVMESFIKAENNGKNICMVYAHNDDMVIGAIQAIKEAGLKPGKDILTGSIDGVPDIYKAMMDGEANASVELTPNMAGPAFDALEKYKKDGTMPEKLTLTKSTLYLPDTAKEELEKKKNMGY

SEQ ID NO: 915 - protein, 228 aa, Escherichia coli
MPAENIVEVHHLKKSVGQGEHELSILTGVELVVKRGETIALVGESGSGKSTLLAILAGLDDGSSGEVSLVGQPLHNMDEEARAKLRAKHVGFVFQSFMLIPTLNALENVELPALLRGESSAESRNGAKALLEQLGLGKRLDHLPAQLSGGEQQRVALARAFNGRPDVLFADEPTGNLDRQTGDKIADLLFSLNREHGTTLIMVTHDLQLAARCDRCLRLVNGQLQEEA

SEQ ID NO: 916 - protein, 615 aa, Escherichia coli
MLNRYPLWKYVMLIVVIVIGLLYALPNLFGEDPAVQITGARGVAASEQTLIQVQKTLQEEKITAKSVALEEGAILARFDSTDTQLRAREALMGVMGDKYVVALNLAPATPRWLAAIHAEPMKLGLDLRGGVHFLMEVDMDTALGKLQEQNIDSLRSDLREKGIPYTTVRKENNYGLSITFRDAKARDEAIAYLSKRHPDLVISSQGSNQLRAVMSDARLSEAREYAVQQNINILRNRVNQLGVAEPVVQRQGADRIVVELPGIQDTARAKEILGATATLEFRLVNTNVDQAAAASGRVPGDSEVKQTREGQPVVLYKRVILTGDHITDSTSSQDEYNQPQVNISLDSAGGNIMSNFTKDNIGKPMATLFVEYKDSGKKDANGRAVLVKQEEVINIANIQSRLGNSFRITGINNPNEARQLSLLLRAGALIAPIQIVEERTIGPTLGMQNIEQGLEACLAGLLVSILFMIIFYKKFGLIATSALIANLILIVGIMSLLPGATLSMPGIAGIVLTLAVAVDANVLINERIKEELSNGRTVQQAIDEGYRGAFSSIFDANITTLIKVIILYAVGTGAIKGFAITTGIGVATSMFTAIVGTRAIVNLLYGGKRVKKLSI

SEQ ID NO: 917 - protein, 192 aa, Escherichia coli
MNAIWIAVAAVSLLGLAFGAILGYASRRFAVEDDPVVEKIDEILPQSQCGQCGYPGCRPYAEAISCNGEKINRCAPGGEAVMLKIAELLNVEPQPLDGEAQEITPARMVAVIDENNCIGCTKCIQACPVDAIVGATRAMHTVMSDLCTGCNLCVDPCPTHCISLQPVAETPDSWKWDLNTIPVRIIPVEHHA

SEQ ID NO: 918 - protein, 330 aa, Escherichia coli
MQSDKVLNLPAGYFGIVLGTIGMGFAWRYASQVWQVSHWLGDGLVILAMIIWGLLTSAFIARLIRFPHSVLAEVRHPVLSSFVSLFPATTMLVAIGFVPWFRPLAVCLFSFGVVVQLAYAAWQTAGLWRGSHPEEATTPGLYLPTVANNFISAMACGALGYTDAGLVFLGAGVFSWLSLEPVILQRLRSSGELPTALRTSLGIQLAPALVACSAWLSVNGGEGDTLAKMLFGYGLLQLLFMLRLMPWYLSQPFNASFWSFSFGVSALATTGLHLGSGSDNGFFHTLAVPLFIFTNFIIAILLIRTFALLMQGKLLVRTERAVLMKAEDKE

SEQ ID NO: 919 - protein, 463 aa, Escherichia coli
MNFPLIANIVVFVVLLFALAQTRHKQWSLAKKVLVGLVMGVVFGLALHTIYGSDSQVLKDSVQWFNIVGNGYVQLLQMIVMPLVFASILSAVARLHNASQLGKISFLTIGTLLFTTLIAALVGVLVTNLFGLTAEGLVQGGAETARLNAIESNYVGKVSDLSVPQLVLSFIPKNPFADLTGANPTSIISVVIFAAFLGVAALKLLKDDAPKGERVLAAIDTLQSWVMKLVRLVMQLTPYGVLALMTKVVAGSNLQDIIKLGSFVVASYLGLLIMFAVHGILLGINGVSPLKYFRKVWPVLTFAFTSRSSAASIPLNVEAQTRRLGVPESIASFAASFGATIGQNGCAGLYPAMLAVMVAPTVGINPLDPMWIATLVGIVTVSSAGVAGVGGGATFAALIVLPAMGLPVTLVALLISVEPLIDMGRTALNVSGSMTAGTLTSQWLKQTDKAILDSEDDAELAHH

SEQ ID NO: 920 - protein, 804 aa, Escherichia coli
MIARWFWREWRSPSLLIVWLALSLAVACVLALGNISDRMEKGLSQQSREFMAGDRALRSSREVPQAWLEEAQKRGLKVGKQLTFATMTFAGDTPQLANVKAVDDIYPMYGDLQTNPPGLKPQAGSVLLAPRLMALLNLKTGDTIDVGDATLRIAGEVIQEPDSGFNPFQMAPRLMMNLADVDKTGAVQPGSRVTWRYKFGGNENQLDGYEKWLLPQLKPEQRWYGLEQDEGALGRSMERSQQFLLLSALLTLLLAVAAVAVAMNHYCRSRYDLVAILKTLGAGRAQLRKLIVGQWLMVLTLSAVTGGAIGLLFENVLMVLLKPVLPAALPPASLWPWLWALGTMTVISLLVGLRPYRLLLATQPLRVLRNDVVANVWPLKFYLPIVSVVVVLLLAGLMGGSMLLWAVLAGAVVLALLCGVLGWMLLNVLRRMTLKSLPLRLAVSRLLRQPWSTLSQLSAFSLSFMLLALLLVLRGDLLDRWQQQLPPESPNYFLINIATEQVAPLKAFLAEHQIVPESFYPVVRARLTAINDKPTEGNEDEALNRELNLTWQNTRPDHNPIVAGNWPPKADEVSMEEGLAKRLNVALGDTVTFMGDTQEFRAKVTSLRKVDWESLRPNFYFIFPEGALDGQPQSWLTSFRWENGNGMLTQLNRQFPTISLLDIGAILKQVGQVLEQVSRALEVMVVLVTACGMLLLLAQVQVGMRQRHQELVVWRTLGAGKKLLRTTLWCEFAMLGFVSGLVAAIGAETALAVLQAKVFDFPWEPDWRLWIVLPCSGALLLSLFGGWLGARLVKGKALFRQFAG

SEQ ID NO: 921 - protein, 461 aa, Escherichia coli
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 922 - protein, 438 aa, Escherichia coli
MKPLHYTASALALGLALMGNAQAVTTIPFWHSMEGELGKEVDSLAQRFNAENPDYKIVPTYKGNYEQNLSAGIAAFRTGNAPAILQVYEVGTATMMASKAIKPVYDVFKEAGIQFDESQFVPTVSGYYSDSKTGHLLSQPFNSSTPVLYYNKDAFKKAGLDPEQPPKTWQDLADYAAKLKASGMKCGYASGWQGWIQLENFSAWNGLPFASKNNGFDGTDAVLEFNKPEQVKHIAMLEEMNKKGDFSYVGRKDESTEKFYNGDCAMTTASSGSLANIREYAKFNYGVGMMPYDADAKDAPQNAIIGGASLWVMQGKDKETYTGVAKFLDFLAKPENAAEWHQKTGYLPITKAAYDLTREQGFYEKNPGADTATRQMLNKPPLPFTKGLRLGNMPQIRVIVDEELESVWTGKKTPQQALDTAVERGNQLLRRFEKSTKS

SEQ ID NO: 923 - protein, 500 aa, Escherichia coli
MKTLFSRLITVIACFFIFSAAWFCLWSISLHLVERPDMAVLLFPFGLRLGLMLQCPRGYWPVLLGAEWLLIYWLTQAVGLTHFPLLMIGSLLTLLPVALISRYRHQRDWRTLLLQGAALTAAALLQSLPWLWHGKESWNALLLTLTGGLTLAPICLVFWHYLANNTWLPLGPSLVSQPINWRGRHLVWYLLLFVISLWLQLGLPDELSRFTPFCLALPIIALAWHYGWQGALIATLMNAIALIASQTWRDHPVDLLLSLLVQSLTGLLLGAGIQRLRELNQSLQKELARNQHLAERLLETEESVRRDVARELHDDIGQTITAIRTQAGIVQRLAADNASVKQSGQLIEQLSLGVYDAVRRLLGRLRPRQLDDLTLEQAIRSLMREMELEGRGIVSHLEWRIDESALSENQRVTLFRVCQEGLNNIVKHADASAVTLQGWQQDERLMLVIEDDGSGLPPGSGQQGFGLTGMRERVTALGGTLHISCLHGTRVSVSLPQRYV

SEQ ID NO: 924 - protein, 454 aa, Escherichia coli
MNDYKMTPGERRATWGLGTVFSLRMLGMFMVLPVLTTYGMALQGASEALIGIAIGIYGLTQAVFQIPFGLLSDRIGRKPLIVGGLAVFAAGSVIAALSDSIWGIILGRALQGSGAIAAAVMALLSDLTREQNRTKAMAFIGVSFGITFAIAMVLGPIITHKLGLHALFWMIAILATTGIALTIWVVPNSSTHVLNRESGMVKGSFSKVLAEPRLLKLNFGIMCLHILLMSTFVALPGQLADAGFPAAEHWKVYLATMLIAFGSVVPFIIYAEVKRKMKQVFVFCVGLIVVAEIVLWNAQTQFWQLVVGVQLFFVAFNLMEALLPSLISKESPAGYKGTAMGVYSTSQFLGVAIGGSLGGWINGMFDGQGVFLAGAMLAAVWLTVASTMKEPPYVSSLRIEIPANIAANEALKVRLLETEGIKEVLIAEEEHSAYVKIDSKVTNRFEIEQAIRQA

SEQ ID NO: 925 - protein, 196 aa, Escherichia coli
MITVALIDDHLIVRSGFAQLLGLEPDLQVVAEFGSGREALAGLPGRGVQVCICDISMPDISGLELLSQLPKGMATIMLSVHDSPALVEQALNAGARGFLSKRCSPDELIAAVHTVATGGCYLTPDIAIKLASGRQDPLTKRERQVAEKLAQGMAVKEIAAELGLSPKTVHVHRANLMEKLGVSNDVELARRMFDGW

SEQ ID NO: 926 - protein, 332 aa, Escherichia coli
MSASSLPLPQGKSVSLKQFVSRHINEIGLLVVIAILYLVFSLNAPGFISLNNQMNVLRDAATIGIAAWAMTLIIISGEIDVSVGPMVAFVSVCLAFLLQFEVPLAVACLLVLLLGALMGTLAGVLRGVFNVPSFVATLGLWSALRGMGLFMTNALPVPIDENEVLDWLGGQFLGVPVSALIMIVLFALFVFISRKTAFGRSVFAVGGNATAAQLCGINVRRVRILIFTLSGLLAAVTGILLAARLGSGNAGAANGLEFDVIAAVVVGGTALSGGRGSLFGTLLGVLVITLIGNGLVLLGINSFFQQVVRGVIIVVAVLANILLTQRSSKAKR

SEQ ID NO: 927 - protein, 368 aa, Escherichia coli
MFHRLWTLIRKELQSLLREPQTRAILILPVLIQVILFPFAATLEVTNATIAIYDEDNGEHSVELTQRFARASAFTHVLLLKSPQEIRPTIDTQKALLLVRFPADFSRKLDTFQTAPLQLILDGRNSNSAQIAANYLQQIVKNYQQELLEGKPKPNNSELVVRNWYNPNLDYKWFVVPSLIAMITTIGVMIVTSLSVAREREQGTLDQLLVSPLTTWQIFIGKAVPALIVATFQATIVLAIGIWAYQIPFAGSLALFYFTMVIYGLSLVGFGLLISSLCSTQQQAFIGVFVFMMPAILLSGYVSPVENMPVWLQNLTWINPIRHFTDITKQIYLKDASLDIVWNSLWPLLVITATTGSAAYAMFRRKVM

SEQ ID NO: 928 - protein, 821 aa, Escherichia coli
MSGNIGANPVIIIGCASAYAVEFNKDLIEAEDRENVNLSQFETDGQLPVGKYSLSTLINNKRTPIHLDLQWVLIDNQTAVCVTPEQLTLLGFTDEFIEKTQQNLIDGCYPIEKEKQITTYLDKGKMQLSISAPQAWLKYKDANWTPPELWNHGIAGAFLDYNLYASHYAPHQGDNSQNISSYGQAGVNLGAWRLRTDYQYDQSFNNGKSQATNLDFPRIYLFRPIPAMNAKLTIGQYDTESSIFDSFHFSGISLKSDENMLPPDLRGYAPQITGVAQTNAKVTVSQNNRIIYQENVPPGPFAITNLFNTLQGQLDVKVEEEDGRVTQWQVASNSIPYLTRKGQIRYTTAMGKPTSVGGDSLQQPFFWTGEFSWGWLNNVSLYGGSVLTNRDYQSLAAGVGFNLNSLGSLSFDVTRSDAQLHNQDKETGYSYRANYSKRFESTGSQLTFAGYRFSDKNFVTMNEYINDTNHYTNYQNEKESYIVTFNQYLESLRLNTYVSLARNTYWDASSNVNYSLSLSRDFDIGPLKNVSTSLTFSRINWEEDNQDQLYLNISIPWGTSRTLSYGMQRNQDNEISHTASWYDSSDRNNSWSVSASGDNDEFKDMKASLRASYQHNTENGRLYLSGTSQRDSYYSLNASWNGSFTATRHGAAFHDYSGSADSRFMIDADGTEDIPLNNKRAVTNRYGIGVIPSVSSYITTSLSVDTRNLPENVDIENSVITTTLTEGAIGYAKLDTRKGYQIIGVIRLADGSHPPLGISVKDETSHKELGLVADGGFVYLNGIQDDNKLALRWGDKSCFIQPPNSSNLTTGTAILPCISQN

SEQ ID NO: 929 - protein, 417 aa, Escherichia coli
MSRTTTVDGAPASDTDKQSISQPNQFIKRGTPQFMRVTLALFSAGLATFALLYCVQPILPVLSQEFGLTPANSSISLSISTAMLAIGLLFTGPLSDAIGRKPVMVTALLLASICTLLSTMMTSWHGILIMRALIGLSLSGVAAVGMTYLSEEIHPSFVAFSMGLYISGNSIGGMSGRLISGVFTDFFNWRIALAAIGCFALASALMFWKILPESRHFRPTSLRPKTLFINFRLHWRDRGLPLLFAEGFLLMGSFVTLFNYIGYRLMLSPWHVSQAVVGLLSLAYLTGTWSSPKAGTMTTRYGRGPVMLFSTGVMLFGLLMTLFSSLWLIFAGMLLFSAGFFAAHSVASSWIGPRAKRAKGQASSLYLFSYYLGSSIAGTLGGVFWHNYGWNGVGAFIALMLVIALLVGTRLHRRLHA

SEQ ID NO: 930 - protein, 325 aa, Escherichia coli
MLLATALLIVGLLLVVYSADRLVFAASILCRTFGIPPLIIGMTVVSIGTSLPEVIVSLAASLHEQRDLAVGTALGSNIINILLILGLAALVRPFTVHSDVLRRELPLMLLVSVVAGSVLYDGQLSRSDGIFLLFLAVLWLLFIVKLARQAERQGTDSLTREQLAELPRDGGLPVAFLWLGIALIIMPVATRMVVDNATVLANYFAISELTMGLTAIAIGTSLPELATAIAGVRKGENDIAVGNIIGANIFNIVIVLGLPALITPGEIDPLAYSRDYSVMLLVSIIFALLCWRRSPQPGRGVGVLLTGGFIVWLAMLYWLSPILVE

SEQ ID NO: 931 - protein, 402 aa, Escherichia coli
MTPSNYQRTRWLTLIGTIITQFALGSVYTWSLFNGALSAKLDAPVSQVAFSFGLLSLGLAISSSVAGKLQERFGVKRVTMASGILLGLGFFLTAHSDNLMMLWLSAGVLVGLADGAGYLLTLSNCVKWFPERKGLISAFAIGSYGLGSLGFKFIDTQLLETVGLEKTFVIWGAIALLMIVFGATLMKDAPKQEVKTSNGVVEKDYTLAESMRKPQYWMLAVMFLTACMSGLYVIGVAKDIAQSLAHLDVVSAANAVTVISIANLSGRLVLGILSDKIARIRVITIGQVISLVGMAALLFAPLNAVTFFAAIACVAFNFGGTITVFPSLVSEFFGLNNLAKNYGVIYLGFGIGSICGSIIASLFGGFYVTFYVIFALLILSLALSTTIRQPEQKMLREAHGSL

SEQ ID NO: 932 - protein, 423 aa, Escherichia coli
MQHNTLSKHNQKLPFTRYDFGWVLLCIGMAIGAGTVLMPVQIGLKGIWVFITAAIIAYPATWVVQDIYLKTLSESDSCNDYTDIISHYLGKNWGIFLGVIYFLMIIHGIFIYSLSVVFDSASYLKTFGLTDADLSQSLLYKVAIFAVLVAIASGGERLLFKISGPMVVVKVGIIVVFGFAMIPHWNFANITAFPQASVFFRDVLLTIPFCFFSAVFIQVLNPMNIAYRKREADKVLATRLALRTHRISYITLIAVILFFAFSFTFSISHEEAVSAFEQNISALALAAQVIPGHIIHITSTVLNIFAVLTAFFGIYLGFHEAIKGIILNLLSRIIDTKKINSRVLTLAICAFIVITLTIWVSFRVSVLVFFQLGSPLYGIVSCLIPFFLIYKVAQLEKLRGFKAWLILLYGILLCLSPLLKLIE

SEQ ID NO: 933 - protein, 111 aa, Escherichia coli
MSYEVLLLGLLVGVANYCFRYLPLRLRVGNARPTKRGAVGILLDTIGIASICALLVVSTAPEVMHDTRRFVPTLVGFAVLGASFYKTRSIIIPTLLSALAYGLAWKVMAII

SEQ ID NO: 934 - protein, 432 aa, Escherichia coli
MQVSVETTQGLGRRVTITIAADSIETAVKSELVNVAKKVRIDGFRKGKVPMNIVAQRYGASVRQDVLGDLMSRNFIDAIIKEKINPAGAPTYVPGEYKLGEDFTYSVEFEVYPEVELQGLEAIEVEKPIVEVTDADVDGMLDTLRKQQATWKEKDGAVEAEDRVTIDFTGSVDGEEFEGGKASDFVLAMGQGRMIPGFEDGIKGHKAGEEFTIDVTFPEEYHAENLKGKAAKFAINLKKVEERELPELTAEFIKRFGVEDGSVEGLRAEVRKNMERELKSAIRNRVKSQAIEGLVKANDIDVPAALIDSEIDVLRRQAAQRFGGNEKQALELPRELFEEQAKRRVVVGLLLGEVIRTNELKADEERVKGLIEEMASAYEDPKEVIEFYSKNKELMDNMRNVALEEQAVEAVLAKAKVTEKETTFNELMNQQA

SEQ ID NO: 935 - protein, 139 aa, Escherichia coli
MNTVCTHCQAINRIPDDRIEDAAKCGRCGHDLFDGEVINATGETLDKLLKDDLPVVIDFWAPWCGPCRNFAPIFEDVAQERSGKVRFVKVNTEAERELSSRFGIRSIPTIMIFKNGQVVDMLNGAVPKAPFDSWLNESL

SEQ ID NO: 936 - protein, 506 aa, Escherichia coli
MSAITESKPTRRWAMPDTLVIIFFVAILTSLATWVVPVGMFDSQEVQYQVDGQTKTRKVVDPHSFRILTNEAGEPEYHRVQLFTTGDERPGLMNFPFEGLTSGSKYGTAVGIIMFMLVIGGAFGIVMRTGTIDNGILALIRHTRGNEILFIPALFILFSLGGAVFGMGEEAVAFAIIIAPLMVRLGYDSITTVLVTYIATQIGFASSWMNPFCVVVAQGIAGVPVLSGSGLRIVVWVIATLIGLIFTMVYASRVKKNPLLSRVHESDRFFREKQADVEQRPFTFGDWLVLIVLTAVMVWVIWGVIVNAWFIPEIASQFFTMGLVIGIIGVVFRLNGMTVNTMASSFTEGARMMIAPALLVGFAKGILLLVGNGEAGDASVLNTILNSIANAISGLDNAVAAWFMLLFQAVFNFFVTSGSGQAALTMPLLAPLGDLVGVNRQVTVLAFQFGDGFSHIIYPTSASLMATLGVCRVDFRNWLKVGATLLGLLFIMSSVVVIGAQLMGYH

SEQ ID NO: 937 - protein, 465 aa, Escherichia coli
MKMVSRITAIGLAGVAICYLGLSGYVWYHDNKRSKQADVQASAVSENNKVLGFLREKGCDYCHTPSAELPAYYYIPGAKQLMDYDIKLGYKSFNLEAVRAALLADKPVSQSDLNKIEWVMQYETMPPTRYTALHWAGKVSDEERAEILAWIAKQRAEYYASNDTAPEHRNEPVQPIPQKLPTDAQKVALGFALYHDPRLSADSTISCAHCHALNAGGVDGRKTSIGVGGAVGPINAPTVFNSVFNVEQFWDGRAATLQDQAGGPPLNPIEMASKSWDEIIAKLEKDPQLKTQFLEVYPQGFSGENITDAIAEFEKTLITPDSPFDKWLRGDENALTAQQKKGYQLFKDNKCATCHGGIILGGRSFEPLGLKKDFNFGEITAADIGRMNVTKEERDKLRQKVPGLRNVALTAPYFHRGDVPTLDGAVKLMLRYQVGKELPQEDVDDIVAFLHSLNGVYTPYMQDKQ

SEQ ID NO: 938 - protein, 223 aa, Escherichia coli
MMQLVHLFMDEITMDPLHAVYLTVGLFVITFFNPGANLFVVVQTSLASGRRAGVLTGLGVALGDAFYSGLGLFGLATLITQCEEIFSLIRIVGGAYLLWFAWCSMRRQSTPQMSTLQQPISAPWYVFFRRGLITDLSNPQTVLFFISIFSVTLNAETPTWARLMAWAGIVLASIIWRVFLSQAFSLPAVRRAYGRMQRVASRVIGAIIGVFALRLIYEGVTQR

SEQ ID NO: 939 - protein, 293 aa, Escherichia coli
MTRQKATLIGLIAIVLWSTMVGLIRGVSEGLGPVGGAAAIYSLSGLLLIFTVGFPRIRQIPKGYLLAGSLLFVSYEICLALSLGYAATHHQAIEVGMVNYLWPSLTILFAILFNGQKTNWLIVPGLLLALVGVCWVLGGDNGLHYDEIINNITTSPLSYFLAFIGAFIWAAYCTVTNKYARGFNGITVFVLLTGASLWVYYFLTPQPEMIFSTPVMIKLISAAFTLGFAYAAWNVGILHGNVTIMAVGSYFTPVLSSALAAVLLSAPLSFSFWQGALMVCGGSLLCWLATRRG

SEQ ID NO: 940 - protein, 393 aa, Escherichia coli
MSHRRSTVKGSLSFANPTVRAWLFQILAVVAVVGIVGWLFHNTVTNLNNRGITSGFAFLDRGAGFGIVQHLIDYQQGDTYGRVFIVGLLNTLLVSALCIVFASVLGFFIGLARLSDNWLLRKLSTIYIEIFRNIPPLLQIFFWYFAVLRNLPGPRQAVSAFDLAFLSNRGLYIPSPQLGDGFIAFILAVVMAIVLSVGLFRFNKTYQIKTGQLRRTWPIAAVLIIGLPLLAQWLFGAALHWDVPALRGFNFRGGMVLIPELAALTLALSVYTSAFIAEIIRAGIQAVPYGQHEAARSLGLPNPVTLRQVIIPQALRVIIPPLTSQYLNIVKNSSLAAAIGYPDMVSLFAGTVLNQTGQAIETIAMTMSVYLIISLTISLLMNIYNRRIAIVER

SEQ ID NO: 941 - protein, 356 aa, Escherichia coli
MAGLKLQAVTKSWDGKTQVIKPLTLDVADGEFIVMVGPSGCGKSTLLRMVAGLERVTEGDIWINDQRVTEMEPKDRGIAMVFQNYALYPHMSVEENMAWGLKIRGMGKQQIAERVKEAARILELDGLLKRRPRELSGGQRQRVAMGRAIVRDPAVFLFDEPLSNLDAKLRVQMRLELQQLHRRLKTTSLYVTHDQVEAMTLAQRVMVMNGGVAEQIGTPVEVYEKPASLFVASFIGSPAMNLLTGRVNNEGTHFELDGGIELPLNGGYRQYAGRKMTLGIRPEHIALSSQAEGGVPMVMDTLEILGADNLAHGRWGEQKLVVRLAHQERPTAGSTLWLHLAENQLHLFDGETGQRV

SEQ ID NO: 942 - protein, 815 aa, Escherichia coli
MNIYRLSFVSCLVMAMPCAMAVEFNLNVLDKSMRDRIDISLLKEKGVIAPGEYFVSVAVNNNKISNGQKINWQKKGDKTIPCINDSLVDKFGLKPDIRQSLPQIDRCIDFSSRPEMLFNFDQANQQLNISIPQAWLAWHSENWAPPSTWKEGVAGVLMDYNLFASSYRPQDGSSSTNLNAYGTAGINAGAWRLRSDYQLNKTDSEDNHDQSGGISRTYLFRPLPQLGSKLTLGETDFSSNIFDGFSYTGAALASDDRMLPWELRGYAPQISGIAQTNATVTISQSGRVIYQKKVPPGPFIIDDLNQSVQGTLDVKVTEEDGRVNNFQVSAASTPFLTRQGQVRYKLAAGQPRPSMSHQTENETFFSNEVSWGMLSNTSLYGGLLISDDDYHSAAMGIGQNMLWLGALSFDVTWASSHFDTQQDERGLSYRFNYSKQVDATNSTISLAAYRFSDRHFHSYANYLDHKYNDSDAQDEKQTISLSVGQPITPLNLNLYANLLHQTWWNADASTTANITAGFNVDIGDWRDISISTSFNTTHYEDKDRDNQIYLSISLPFGNGGRVGYDMQNSSHSTIHRMSWNDTLDERNSWGMSAGLQSDRPDNGAQVSGNYQHLSSAGEWDISGTYAASDYSSVSSSWSGSFTATQYGAAFHRRSSTNEPRLMVSTDGVADIPVQGNLDYTNHFGIAVVPLISSYQPSTVAVNMNDLPDGVTVAENVIKETWIEGAIGYKSLASRSGKDVNVIIRNASGQFPPLGADIRQDDSGISVGMVGEEGHAWLSGVAENQLFTVVWGEQSCIIHLPERLEDTTKRLILPCH

SEQ ID NO: 943 - protein, 457 aa, Escherichia coli
MNQQLSWRTIVGYSLGDVANNFAFAMGALFLLSYYTDVAGVGAAAAGTMLLLVRVFDAFADVFAGRVVDSVNTRWGKFRPFLLFGTAPLMIFSVLVFWVLTDWSHGSKVVYAYLTYMGLGLCYSLVNIPYGSLATAMTQQPQSRARLGAARGIAASLTFVCLAFLIGPSIKNSSPEEMVSVYHFWTIVLAIAGMVLYFICFKSTRENVVRIVAQPSLNISLQTLKRNRPLFMLCIGALCVLISTFAVSASSLFYVRYVLNDTGLFTVLVLVQNLVGTVASAPLVPGMVARIGKKNTFLIGALLGTCGYLLFFWVSVWSLPVALVALAIASIGQGVTMTVMWALEADTVEYGEYLTGVRIEGLTYSLFSFTRKCGQAIGGSIPAFILGLSGYIANQVQTPEVIMGIRTSIALVPCGFMLLAFVIIWFYPLTDKKFKEIVVEIDNRKKVQQQLISDITN

SEQ ID NO: 944 - protein, 741 aa, Escherichia coli
MRWILFILFCLLGAPAHAVSIPGVTTTTTTDSTTEPAPEPDIEQKKAAYGALADVLDNDTSRKELIDQLRTVAATPPAEPVPKIVPPTLVEEQTVLQKVTEVSRHYGEALSARFGQLYRNITGSPHKPFNPQTFSNALTHFSMLAVLVFGFYWLIRLCALPLYRKMGQWARQKNRERSNWLQLPAMIIGAFIIDLLLLALTLFVGQVLSDNLNAGSRTIAFQQSLFLNAFALIEFFKAVLRLIFCPNVAELRPFTIQDESARYWSRRLSWLSSLIGYGLIVAVPIISNQVNVQIGALANVIIMLCMTVWALYLIFRNKKEITQHLLNFAEHSLAFFSLFIRAFALVWHWLASAYFIVLFFFSLFDPGNSLKFMMGATVRSLAIIGIAAFVSGMFSRWLAKTITLSPHTQRNYPELQKRLNGWLSAALKTARILTVCVAVMLLLSAWGLFDFWNWLQNGAGQKTVDILIRIALILFFSAVGWTVLASLIENRLASDIHGRPLPSARTRTLLTLFRNALAVIISTITIMIVLSEIGVNIAPLLAGAGALGLAISFGSQTLVKDIITGVFIQFENGMNTGDLVTIGPLTGTVERMSIRSVGVRQDTGAYHIIPWSSITTFANFVRGIGSVVANYDVDRHEDADKANQALKDAVAELMENEEIRGLIIGEPNFAGIVGLSNTAFTLRVSFTTLPLKQWTVRFALDSQVKKHFDLAGVRAPVQTYQVLPAPGATPAEPLPPGEPTL

SEQ ID NO: 945 - protein, 86 aa, Escherichia coli
MALLITKKCINCDMCEPECPNEAISMGDHIYEINSDKCTECVGHYETPTCQKVCPIPNTIVKDPAHVETEEQLWDKFVLMHHADKI

SEQ ID NO: 946 - protein, 427 aa, Escherichia coli
MALNTPQITPTKKITVRAIGEELPRGDYQRCPQCDMLFSLPEINSHQSAYCPRCQAKIRDGRDWSLTRLAAMAFTMLLLMPFAWGEPLLHIWLLGIRIDANVMQGIWQMTKQGDAITGSMVFFCVIGAPLILVTSIAYLWFGNRLGMNLRPVLLMLERLKEWVMLDIYLVGIGVASIKVQDYAHIQAGVGLFSFVALVILTTVTLSHLNVEELWERFYPQRPATRRDEKLRVCLGCHFTGYPDQRGRCPRCHIPLRLRRRHSLQKCWAALLASIVLLLPANLLPISIIYLNGGRQEDTILSGIMSLASSNIAVAGIVFIASILVPFTKVIVMFTLLLSIHFKCQQGLRTRILLLRMVTWIGRWSMLDLFVISLTMSLINRDQILAFTMGPAAFYFGAAVILTILAVEWLDSRLLWDAHESGNARFDD

SEQ ID NO: 947 - protein, 487 aa, Escherichia coli
MKPSTEWWRYLAPLAVIAIIALLPVPAGLENHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASHATLSWGDWFLGMLPLSILLVLLVPWLAYVLYPPVLKSGDQVPRWAETELQAMGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSALAPMMIAAALAMPEIPLPVFCLMVGAAIGLGSILTPYATGPSPIYYGSGYLPTADYWRLGAIFGLIFLVLLVITGLLWMPVVLL

SEQ ID NO: 948 - protein, 457 aa, Escherichia coli
MPKVQADGLPLPQRYGAILTIVIGISMAVLDGAIANVALPTIATDLHATPASSIWVVNAYQIAIVISLLSFSFLGDMFGYRRIYKCGLVVFLLSSLFCALSDSLQMLTLARVIQGFGGAALMSVNTALIRLIYPQRFLGRGMGINSFIVAVSSAAGPTIAAAILSIASWKWLFLINVPLGIIALLLAMRFLPPNGSRASKPRFDLPSAVMNALTFGLLITALSGFAQGQSLTLIAAELVVMVVVGIFFIRRQLSLPVPLLPVDLLRIPLFSLSICTSVCSFCAQMLAMVSLPFYLQTVLGRSEVETGLLLTPWPLATMVMAPLAGYLIERVHAGLLGALGLFIMAAGLFSLVLLPASPADINIIWPMILCGAGFGLFQSPNNHTIITSAPRERSGGASGMLGTARLLGQSSGAALVALMLNQFGDNGTHVSLMAAAILAVIAACVSGLRITQPRSRA

SEQ ID NO: 949 - protein, 110 aa, Escherichia coli
MSFFISDAVAATGAPAQGSPMSLILMLVVFGLIFYFMILRPQQKRTKEHKKLMDSIAKGDEVLTNGGLVGRVTKVAENGYIAIALNDTTEVVIKRDFVAAVLPKGTMKAL

SEQ ID NO: 950 - protein, 157 aa, Escherichia coli
MKKILEAILAINLAVLSCIVFINIILRYGFQTSILSVDELSRYLFVWLTFIGAIVAFMDNAHVQVTFLVEKLSPAWQRRVALVTHSLILFICGALAWGATLKTIQDWSDYSPILGLPIGLMYAACLPTSLVIAFFELRHLYQLITRSNSLTSPPQGA

SEQ ID NO: 951 - protein, 220 aa, Escherichia coli
MELLTQLLQALWAQDFETLANPSMIGMLYFVLFVILFLENGLLPAAFLPGDSLLVLVGVLIAKGAMGYPQTILLLTVAASLGCWVSYIQGRWLGNTRTVQNWLSHLPAHYHQRAHHLFHKHGLSALLIGRFIAFVRTLLPTIAGLSGLNNARFQFFNWMSGLLWVLILTTLGYMLGKTPVFLKYEDQLMSCLMLLPVVLLVFGLAGSLVVLWKKKYGNRG

SEQ ID NO: 952 - protein, 327 aa, Escherichia coli
MPTKMRTTRNLLLMATLLGSALFARAAEKEMTIGAIYLDTQGYYAGVRQGVQDAAKDSSVQVQLIETNAQGDISKESTFVDTLVARNVDAIILSAVSENGSSRTVRRASEAGIPVICYNTCINQKGVDKYVSAYLVGDPLEFGKKLGNAAADYFIANKIDQPKIAVINCEAFEVCVQRRKGFEEVLKSRVPGAQIVANQEGTVLDKAISVGEKLIISTPDLNAIMGESGGATLGAVKAVRNQNQAGKIAVFGSDMTTEIAQELENNQVLKAVVDISGKKMGNAVFAQTLKVINKQADGEKVIQVPIDLYTKTEDGKQWLATHVDGLP

SEQ ID NO: 953 - protein, 308 aa, Escherichia coli [sequence omitted]

SEQ ID NO: 954 - protein, 700 aa, Escherichia coli
MFPPMWRRLIYHPDINYALRQTLVLCLPVAVGLMLGELRFGLLFSLVPACCNIAGLDTPHKRFFKRLIIGASLFATCSLLTQLLLAKDVPLPFLLTGLTLVLGVTAELGPLHAKLLPASLLAAIFTLSLAGYMPVWEPLLIYALGTLWYGLFNWFWFWIWREQPLRESLSLLYRELADYCEAKYSLLTQHTDPEKALPPLLVRQQKAVDLITQCYQQMHMLSAQNNTDYKRMLRIFQEALDLQEHISVSLHQPEEVQKLVERSHAEEVIRWNAQTVAARLRVLADDILYHRLPTRFTMEKQIGALEKIARQHPDNPVGQFCYWHFSRIARVLRTQKPLYARDLLADKQRRMPLLPALKSYLSLKSPALRNAGRLSVMLSVASLMGTALHLPKSYWILMTVLLVTQNGYGATRLRIVNRSVGTVVGLIIAGVALHFKIPEGYTLTLMLITTLASYLILRKNYGWATVGFTITAVYTLQLLWLNGEQYILPRLIDTIIGCLIAFGGTVWLWPQWQSGLLRKNAHDALEAYQEAIRLILSEDPQPTPLAWQRMRVNQAHNTLYNSLNQAMQEPAFNSHYLADMKLWVTHSQFIVEHINAMTTLAREHRALPPELAQEYLQSCEIAIQRCQQRLEYDEPGSSGDANIMDAPEMQPHEGAAGTLEQHLQRVIGHLNTMHTISSMAWRQRPHHGIWLSRKLRDSKA

SEQ ID NO: 955 - protein, 561 aa, Escherichia coli
MNINVAELLNGNYILLLFVVLALGLCLGKLRLGSIQLGNSIGVLVVSLLLGQQHFSINTDALNLGFMLFIFCVGVEAGPNFFSIFFRDGKNYLMLALVMVGSALVIALGLGKLFGWDIGLTAGMLAGSMTSTPVLVGAGDTLRHSGMESRQLSLALDNLSLGYALTYLIGLVSLIVGARYLPKLQHQDLQTSAQQIARERGLDTDANRKVYLPVIRAYRVGPELVAWTDGKNLRELGIYRQTGCYIERIRRNGILANPDGDAVLQMGDEIALVGYPDAHARLDPSFRNGKEVFDRDLLDMRIVTEEVVVKNHNAVGKRLAQLKLTDHGCFLNRVIRSQIEMPIDDNVVLNKGDVLQVSGDARRVKTIADRIGFISIHSQVTDLLAFCAFFVIGLMIGMITFQFSTFSFGMGNAAGLLFAGIMLGFMRANHPTFGYIPQGALSMVKEFGLMVFMAGVGLSAGSGINNGLGAIGGQMLIAGLIVSLVPVVICFLFGAYVLRMNRALLFGAMMGARTCAPAMEIISDTARSNIPALGYAGTYAIANVLLTLAGTIIVMVWPGLG

SEQ ID NO: 956 - protein, 352 aa, Escherichia coli
MRADKSLSPFEIRVYRHYRIVHGTRVALAFLLTFLIIRLFTIPESTWPLVTMVVIMGPISFWGNVVPRAFERIGGTVLGSILGLIALQLELISLPLMLVWCAAAMFLCGWLALGKKPYQGLLIGVTLAIVVGSPTGEIDTALWRSGDVILGSLLAMLFTGIWPQRAFIHWRIQLAKSLTEYNRVYQSAFSPNLLERPRLESHLQKLLTDAVKMRGLIAPASKETRIPKSIYEGIQTINRNLVCMLELQINAYWATRPSHFVLLNAQKLRDTQHMMQQILLSLVHALYEGNPQPVFANTEKLNDAVEELRQLLNNHHDLKVVETPIYGYVWLNMETAHQLELLSNLICRALRK

SEQ ID NO: 957 - protein, 409 aa, Escherichia coli
MSNIWSKEETLWSFALYGTAVGAGTLFLPIQLGSAGAVVLFITALVAWPLTYWPHKALCQFILSSKTSAGEGITGAVTHYYGKKIGNLITTLYFIAFFVVVLIYAVAITNSLTEQLAKHMVIDLRIRMLVSLGVVLILNLIFLMGRHATIRVMGFLVFPLIAYFLFLSIYLVGSWQPDLLTTQVEFNQNTLHQIWISIPVMVFAFSHTPIISTFAIDRREKYGEHAMDKCKKIMKVAYLIICISVLFFVFSCLLSIPPSYIEAAKEEGVTILSALSMLPNAPAWLSISGIIVAVVAMSKSFLGTYFGVIEGATEVVKTTLQQVGVKKSRAFNRALSIMLVSLITFIVCCINPNAISMIYAISGPLIAMILFIMPTLSTYLIPALKPWRSIGNLITLIVGILCVSVMFFS

SEQ ID NO: 958 - protein, 307 aa, Escherichia coli
MGSTRKGMLNVLIAAVLWGSSGVCAQYIMEQSQMSSQFLTMTRLIFAGLILLTLSFVHGDKIFSIINNHKDAISLLIFSVVGALTVQLTFLLTIEKSNAATATVLQFLSPTIIVAWFSLVRKSRPGILVFCAILTSLVGTFLLVTHGNPTSLSISPAALFWGIASAFAAAFYTTYPSTLIARYGTLPVVGWSMLIGGLILLPFYARQGTNFVVNGSLILAFFYLVVIGTSLTFSLYLKGAQLIGGPKASILSCAEPLSSALLSLLLLGITFTLPDWLGTLLILSSVILISMDSRRRARKINRPARHK

SEQ ID NO: 959 - protein, 96 aa, Escherichia coli
MKLKIVAVVVTGLLAANVAHAAEVYNKDGNKLDLYGKVTALRYFTDDKRDDGDKTYARLGFKGETQINDQMIGFGHWEYDFKGYNDEANGSRGKNL

SEQ ID NO: 960 - protein, 637 aa, Escherichia coli
MIVFSSLQIRRGVRVLLDNATATINPGQKVGLVGKNGCGKSTLLALLKNEISADGGSYTFPGSWQLAWVNQETPALPQAALEYVIDGDREYRQLEAQLHDANERNDGHAIATIHGKLDAIDAWSIRSRAASLLHGLGFSNEQLERPVSDFSGGWRMRLNLAQALICRSDLLLLDEPTNHLDLDAVIWLEKWLKSYQGTLILISHDRDFLDPIVDKIIHIEQQSMFEYTGNYSSFEVQRATRLAQQQAMYESQQERVAHLQSYIDRFRAKATKAKQAQSRIKMLERMELIAPAHVDNPFRFSFRAPESLPNPLLKMEKVSAGYGDRIILDSIKLNLVPGSRIGLLGRNGAGKSTLIKLLAGELAPVSGEIGLAKGIKLGYFAQHQLEYLRADESPIQHLARLAPQELEQKLRDYLGGFGFQGDKVTEETRRFSGGEKARLVLALIVWQRPNLLLLDEPTNHLDLDMRQALTEALIEFEGALVVVSHDRHLLRSTTDDLYLVHDRKVEPFDGDLEDYQQWLSDVQKQENQTDEAPKENANSAQARKDQKRREAELRAQTQPLRKEIARLEKEMEKLNAQLAQAEEKLGDSELYDQSRKAELTACLQQQASAKSGLEECEMAWLEAQEQLEQMLLEGQSN

SEQ ID NO: 961 - protein, 421 aa, Escherichia coli
MLTKKKWALFSLLTLCGGTIYKLPSLKDAFYIPMQEYFHLTNGQIGNAMSVNSFVTTVGFFLSIYFADKLPRRYTMSFSLIATGLLGVYLTTMPGYWGILFVWALFGVTCDMMNWPVLLKSVSRLGNSEQQGRLFGFFETGRGIVDTVVAFSALAVFTWFGSGLLGFKAGIWFYSLIVIAVGIIIFFVLNDKEEAPSVEVKKEDGASKNTSMTSVLKDKTIWLIAFNVFFVYAVYCGLTFFIPFLKNIYLLPVALVGAYGIINQYCLKMIGGPIGGMISDKILKSPSKYLCYTFIISTAALVLLIMLPHESMPVYLGMACTLGFGAIVFTQRAVFFAPIGEAKIAENKTGAAMALGSFIGYAPAMFCFSLYGYILDLNPGIIGYKIVFGIMACFAFSGAVVSVMLVKRISQRKKEMLAAEA

SEQ ID NO: 962 - protein, 343 aa, Escherichia coli
MIAELFTNNALNLVIIFGSCAALILMSFWFRRGNRKRKGFLFHAVQFLIYTIIISAVGSIINYVIENYKLKFITPGVIDFICTSLIAVILTIKLFLLINQFEKQQIKKGRDITSARIMSRIIKITIIVVLVLLYGEHFGMSLSGLLTFGGIGGLAVGMAGKDILSNFFSGIMLYFDRPFSIGDWIRSPDRNIEGTVAEIGWRITKITTFDNRPLYVPNSLFSSISVENPGRMTNRRITTTIGLRYEDAAKVGVIVEAVREMLKNHPAIDQRQTLLVYFNQFADSSLNIMVYCFTKTTVWAEWLAAQQDVYLKIIDIVQSHGADFAFPSQTLYMDNITPPEQGR

SEQ ID NO: 963 - protein, 154 aa, Escherichia coli
MKLRDSLAENKSIRLQAEAETWQEAVKIGVDLLVAADVVEPRYYQAILDGVEQFGPYFVIAPGLAMPHGRPEEGVKKTGFSLVTLKKPLEFNHDDNDPVDILITMAAVDANTHQEVGIMQIVNLFEDEENFDRLRACRTEQEVLDLIDRTNAAA

SEQ ID NO: 964 - protein, 341 aa, Escherichia coli
  MISC_FEATURE (23)...(23): Xaa is any amino acid
MKKMMIATLAAASVLLAVANQAXAGATLDAVQKKGFVQCGISDGLPGFSYADADGKFSGIDVDICRGVAAAVFGDDTKVKYTPLTAKERFTALQSGEVDLLSRNTTWTSSRDAGMGMAFTGVTYYDGIGFLTHDKAGLKSAKELDGATVCIQAGTDTELNVADYFKANNMKYTPVTFDRSDESAKALESGRCDTLASDQSQLYALRIKLSNPAEWIVLPEVISKEPLGPVVRRGDDEWFSIVRWTLFAMLNAEEMGINSQNVDEKAANPATPDMAHLLGKEGDYGKDLKLDNKWAYNIIKQVGNYSEIFERNVGSESPLKIKRGQNNLWNNGGIQYAPPVR

SEQ ID NO: 965 - protein, 337 aa, Escherichia coli
MTQENEIKRPIQDLEHEPIKPLDNSEKGSKVSQALETVTTTAEKVQRQPVIAHLIRATERFNDRLGNQFGAAITYFSFLSMIPILMVSFAAGGFVLASHPMLLQDIFDKILQNISDPTLAATLKNTINTAVQQRTTVGLVGLAVALYSGINWMGNLREAIRAQSRDVWERSPQDQEKFWVKYLRDFISLIGLLIALIVTLSITSVAGSAQQMIISALHLNSIEWLKPTWRLIGLAISIFANYLLFFWIFWRLPRHRPRKKALIRGTFLAAIGFEVIKIVMTYTLPSLMKSPSGAAFGSVLGLMAFFYFFARLTLFCAAWIATAEYKDDPRMPGKTQP

SEQ ID NO: 966 - protein, 310 aa, Escherichia coli
MLHKKTLLFAALSAALWGGATQAADAAVVASLKPVGFIASAIADGVTETEVLLPDGASEHDYSLRPSDVKRLQNADLVVWVGPEMEAFMQKPVSKLPGAKQVTIAQLEDVKPLLMKSIHGDDDDHDHAEKSDEDHHHGDFNMHLWLSPEIARATAVAIHGKLVELMPQSRAKLDANLKDFEAQLASTETQVGNELAPLKGKGYFVFHDAYGYFEKQFGLTPLGHFTVNPEIQPGAQRLHEIRTQLVEQKATCVFAEPQFRPAVVESVARGTSVRMGTLDPLGTNIKLGKTSYSEFLSQLANQYASCLKGD

SEQ ID NO: 967 - protein, 306 aa, Escherichia coli
MRFRQLLPLFGALFALYIIWGSTYFVIRIGVESWPPLMMAGVRFLAAGILLLAFLLLRGHKLPPLRPLLNAALIGLLLLAVGNGMVTVAEHQNVPSGIAAVVVATVPLFTLCFSRLFGIKTRKLEWVGIAIGLAGIIMLNSGGNLSGNPWGAILILIGSISWAFGSVYGSRITLPVGMMAGAIEMLAAGVVLMIASMIAGEKLTALPSLSGFLAVGYLALFGSIIAINAYMYLIRNVSPALATSYAYVNPVVAVLLGTGLGGETLSKIEWLALGVIVFAVVLVTLGKYLFPAKPVVAPVIQDASSE

SEQ ID NO: 968 - protein, 161 aa, Escherichia coli
MKRKVLAMLVPALLVAGAANAAEVYNKDGNKLDLYGKVVGLHYFSDDSGSDGDMSYARIGFKGETQIADQFTGYGQWEFNIGANGPESDKGNTATRLAFAGLGFGQNGTFDYGRNYGVVYDVEAWTDMLPEFGGDTYAGADNFMNGRANGVATYRNNGFFG

SEQ ID NO: 969 - protein, 461 aa, Escherichia coli
MSHITTEDPATLRLPFKEKLSYGIGDLASNILLDIGTLYLLKFYTDVLGLPGTYGGIIFLISKFFTAFTDMGTGIMLDSRRKIGPKGKFRPFILYASFPVTLLAIANFVGTPFDVTGKTVMATILFMLYGLFFSMMNCSYGAMVPAITKNPNERASLAAWRQGGATLGLLLCTVGFVPVMNLIEGNQQLGYIFAATLFSLFGLLFMWICYSGVKERYVETQPANPAQKPGLLQSFRAIAGNRPLFILCIANLCTLGAFNVKLAIQVYYTQYVLNDPILLSYMGFFSMGCIFIGVFLMPASVRRFGKKKVYIGGLLIWVLGDLLNYFFGGGSVSFVAFSCLAFFGSAFVNSLNWALVSDTVEYGEWRTGVRSEGTVYTGFTFFRKVSQALAGFFPGWMLTQIGYVPNVAQADHTIEGLRQLIFIYPSALAVVTIVAMGCFYSLNEKMYVRIVEEIEARKRTA

SEQ ID NO: 970 - protein, 700 aa, Escherichia coli
MKIFSVRQTVLPALLVLSPVVFAADEQTMIVSAAPQVVSELDTPAAVSVVDGEEMRLATPRINLSESLTGVPGLQVQNRQNYAQDLQLSIRGFGSRSTYGIRGIRLYVDGIPATMPDGQGQTSNIDLSSVQNVEVLRGPFSALYGNASGGVMNVTTQTGQQPPTIEASSYYGSFGSWRYGLKATGATGDGTQPGDVDYTVSTTRFTTHGYRDHSGAQKNLANAKLGVRIDEASKLSLIFNSVDIKADDPGGLTKAEWKANPQQAPRAEQYDTRKTIKQTQAGLRYERSLSSRDDMSVMMYAGERETTQYQSIPMAPQLNPSHAGGVITLQRHYQGIDSRWTHRGELGVPVTFTTGLNYENMSENRKGYNNFRLNSGMPEYGQKGELRRDERNLMWNIDPYLQTQWQLSEKLSLDAGVRYSSVWFDSNDHYVTPGNGDDSGDASYHKWLPAGSLKYAMTDAWNIYLAAGRGFETPTINELSYRADGQSGMNLGLKPSTNDTIEIGSKTRIGDGLLSLALFQTDTDDEIVVDSSSGGRTTYKNAGKTRRQGAELAWDQRFAGDFRVNASWTWLDATYRSNVCNEQDCNGNRMPGIARNMGFASIGYVPEDGWYAGTEARYMGDIMADDENTAKAPSYTLVGLFTGYKYNYHNLTVDLFGRVDNLFDKEYVGSVIVNESNGRYYEPSPGRNYGVGMNIAWRFE

SEQ ID NO: 971 - protein, 157 aa, Escherichia coli
MNRFIIADATKCIGCRTCEVACAVSHHENQDCAALSPDEFISRIRVIKDHCWTTAVACHQCEDAPCANVCPVDAISREHGHIFVEQTRCIGCKSCMLACPFGAMEVVSSRKKARAIKCDLCWHRETGPACVEACPTKALQCMDVEKVQRHRLRQQPV

SEQ ID NO: 972 - protein, 475 aa, Escherichia coli
MSIKTSNTDFKTRIRQQIEDPIMRKAVANAQQRIGANRQKMVDELGHWEEWRDRAAQIRDHVLSNLDAYLYQLSEKVTQNGGHVYFARTKEDATRYILQVAQRKNARKVVKSKSMVTEEIGVNHVLQDAGIQVIETDLGEYILQLDQDPPSHVVVPAIHKDRHQIRRVLHERLGYEGPETPEAMTLFIRQKIREDFLSAEIGITGCNFAVAETGSVCLVTNEGNARMCTTLPKTHIAVMGMERIAPTFAEVDVLITMLARSAVGARLTGYNTWLTGPREAGHVDGPEEFHLVIVDNGRSEVLASEFRDVLRCIRCGACMNTCPAYRHIGGHGYGSIYPGPIGAVISPLLGGYKDFKDLPYACSLCTACDNVCPVRIPLSKLILRHRRVMAEKGITAKAEQRAIKMFAYANSHPGLWKVGMMAGAHAASWFINGGKTPLKFGAISDWMEARDLPEADGESFRSWFKKHQAQEKKNG

SEQ ID NO: 973 - protein, 838 aa, Escherichia coli
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 974 - protein, 460 aa, Escherichia coli
MKSEVLSVKEKIGYGMGDAASHIIFDNVMLYMMFFYTDIFGIPAGFVGTMFLVARALDAISDPCMGLLADRTRSRWGKFRPWVLFGALPFGIVCVLAYSTPDLSMNGKMIYAAITYTLLTLLYTVVNIPYCALGGVITNDPTQRISLQSWRFVLATAGGMLSTVLMMPLVNLIGGDNKPLGFQGGIAVLSVVAFMMLAFCFFTTKERVEAPPTTTSMREDLRDIWQNDQWRIVGLLTIFNILAVCVRGGAMMYYVTWILGTPEVFVAFLTTYCVGNLIGSALAKPLTDWKCKVTIFWWTNALLAVISLAMFFVPMQASITMFVFIFVIGVLHQLVTPIQWVMMSDTVDYGEWCNGKRLTGISFAGTLFVLKLGLAFGGALIGWMLAYGGYDAAEKAQNSATISIIIALFTIVPAICYLLSAIIAKRYYSLTTHNLKTVMEQLAQGKRRCQQQFTSQEVQN

SEQ ID NO: 975 - protein, 366 aa, Escherichia coli
MRGKKRIGLLFLLIAVVVGGGGLLLAQKVLHKTSDTAFCLSCHSMSKPFEEYQGTVHFSNQKGIRAECADCHIPKSGMDYLFAKLKASKDIYHEFVSGKIDSDDKFEAHRQEMAETVWKELKATDSATCRSCHSFDAMDIASQSESAQKMHNKAQKDSETCIDCHKGIAHFPPEIKMDDNAAHELESQAATSVTNGAHIYPFKTSHIGELATVNPGTDLTVVDASGKQPIVLLQGYQMQGSENTLYLAAGQRLALATLSEEGIKALTVNGEWQADEYGNQWRQASLQGALTDPALADRKPLWQYAEKLDDTYCAGCHAPIAADHYTVNAWPSIAKGMGARTSMSENELDILTRYFQYNAKDITEKQ

SEQ ID NO: 976 - protein, 877 aa, Escherichia coli
MSQETPASTTEAQIKNKRRISPFWLLPFIALMIASWLIWDSYQDRGNTVTIDFMSADGIVPGRTPVRYQGVEVGTVQDISLSDDLRKIEVKVSIKSDMKDALREETQFWLVTPKASLAGVSGLDALVGGNYIGMMPGKGKEQDHFVALDTQPKYRLDNGDLMIHLQAPDLGSLNSGSLVYFRKIPVGKVYDYAINPNKQGVVIDVLIERRFTDLVKKGSRFWNVSGVDANVSISGAKVKLESLAALVNGAIAFDSPEESKPAEAEDTFGLYEDLAHSQRGVIIKLELPSGAGLTADSTPLMYQGLEVGQLTKLDLNPGGKVTGEMTVDPSVVTLLRENTRIELRNPKLSLSDANLSALLTGKTFELVPGDGEPRKEFVVVPGEKALLHEPDVLTLTLTAPESYGIDAGQPLILHGVQVGQVIDRKLTSKGVTFTVAIEPQHRELVKGDSKFVVNSRVDVKVGLDGVEFLGASASEWINGGIRILPGDKGEMKASYPLYANLEKALENSLSDLPTTTVSLSAETLPDVQAGSVVLYRKFEVGEVITVRPRANAFDIDLHIKPEYRNLLTSNSVFWAEGGAKVQLNGSGLTVQASPLSRALKGAISFDNLSGASASQRKGDKRILYASETAARAVGGQITLHAFDAGKLAVGMPIRYLGIDIGQIQTLDLITARNEVQAKAVLYPEYVQTFARGGTRFSVVTPQISAAGVEHLDTILQPYINVEPGRGNPRRDFELQEATITDSRYLDGLSIIVEAPEAGSLGIGTPVLFRGLEVGTVTGMTLGTLSDRVMIAMRISKRYQHLVRNNSVFWLASGYSLDFGLTGGVVKTGTFNQFIRGGIAFATPPGTPLAPKAQEGKHFLLQESEPKEWREWGTALPK

SEQ ID NO: 977 - protein, 430 aa, Escherichia coli
MIKSKIVLLSALVSCALISGCKEENKTNVSIEFMHSSVEQERQAVISKLIARFEKENPGITVKQVPVEEDAYNTKVITLSRSGSLPEVIETSHDYAKVMDKEQLIDRKAVATVISNVGEGAFYDGVLRIVRTEDGSAWTGVPVSAWIGGIWYRKDVLAKAGLEEPKNWQQLLDVAQKLNDPANKKYGIALPTAESVLTEQSFSQFALSNQANVFNAEGKITLDTPEMMQALTYYRDLTANTMPGSNDIMEVKDAFMNGTAPMAIYSTYILPAVIKEGDPKNVGFVVPTEKNSAVYGMLTSLTITAGQKTEETEAAEKFVTFMEQADNIADWVMMSPGAALPVNKAVVTTATWKDNDVIKALGELPNQLIGELPNIQVFGAVGDKNFTRMGDVTGSGVVSSMVHNVTVGKADLSTTLQASQKKLDELIEQH

SEQ ID NO: 978 - protein, 367 aa, Escherichia coli
MTKVLLSHPPRPASHNSSRAMVWVRKNLFSSWSNSLLTIGCIWLMWELIPPLLNWAFLQANWVGSTRADCTKAGACWVFIHERFGQFMYGLYPHDQRWRINLALLIGLVSIAPMFWKILPHRGRYIAAWAVIYPLIVWWLMYGGFFALERVETRQWGGLTLTLIIASVGIAGALPWGILLALGRRSHMPIVRILSVIFIEFWRGVPLITVLFMSSVMLPLFMAEGTSIDKLIRALVGVILFQSAYVAEVVRGGLQALPKGQYEAAESLALGYWKTQGLVILPQALKLVIPGLVNTIIALFKDTSLVIIIGLFDLFSSVQQATVDPAWLGMSTEGYVFAALIYWIFCFSMSRYSQYLEKRFNTGRTPH

SEQ ID NO: 979 - protein, 394 aa, Escherichia coli
MQKTATTPSKILDLTAAAFLLVAFLTGIAGALQTPTLSIFLADELKARPIMVGFFFTGSAIMGILVSQFLARHSDKQGDRKLLILLCCLFGVLACTLFAWNRNYFILLSTGVLLSSFASTANPQMFALAREHADRTGRETVMFSTFLRAQISLAWVIGPPLAYELAMGFSFKVMYLTAAIAFVVCGLIVWLFLPSIQRNIPVVTQPVEILPSTHRKRDTRLLFVVCSMMWAANNLYMINMPLFIIDELHLTDKLTGEMIGIAAGLEIPMMLIAGYYMKRIGKRLLMLIAIVSGMCFYASVLMATTPAVELELQILNAIFLGILCGIGMLYFQDLMPEKIGSATTLYANTSRVGWIIAGSVDGIMVEIWSYHALFWLAIGMLGIAMICLLFIKDI

SEQ ID NO: 980 - protein, 465 aa, Escherichia coli
MEILYNIFTVFFNQVMTNAPLLLGIVTCLGYILLRKSVSVIIKGTIKTIIGFMLLQAGSGILTSTFKPVVAKMSEVYGINGAISDTYASMMATIDRMGDAYSWVGYAVLLALALNICYVLLRRITGIRTIMLTGHIMFQQAGLIAVTLFIFGYSMWTTIICTAILVSLYWGITSNMMYKPTQEVTDGCGFSIGHQQQFASWIAYKVAPFLGKKEESVEDLKLPGWLNIFHDNIVSTAIVMTIFFGAILLSFGIDTVQAMAGKVHWTVYILQTGFSFAVAIFIITQGVRMFVAELSEAFNGISQRLIPGAVLAIDCAAIYSFAPNAVVWGFMWGTIGQLIAVGILVACGSSILIIPGFIPMFFSNATIGVFANHFGGWRAALKICLVMGMIEIFGCVWAVKLTGMSAWMGMADWSILAPPMMQGFFSIGIAFMAVIIVIALAYMFFAGRALRAEEDAEKQLAEQSA

SEQ ID NO: 981 - protein, 430 aa, Escherichia coli
MMNTEGNNGNKPLGLWNVVSIGIGAMVGAGIFALLGQAALLMEASTWVAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPQVIMPRAFLVAIGVTTLLYISLALVLLSDVSALELEKYADTAVAQAASPLLGHVGYVIVVIGALLATASAINANLFAVFNIMDNMGSERELPKLMNKSLWRQSTWGNIIVVVLIMLMTAALNLGSLASVASATFLICYLAVFVVAIRLRHDIHASLPILIVGTLVMLLVIVGFIYSLWSQGSRALIWIIGSLLLSLIVAMVMKRNKTV

SEQ ID NO: 982 - protein, 349 aa, Escherichia coli
METPQPDKTGMHILLKLASLVVILAGIHAAADIIVQLLLALFFAIVLNPLVTWFIRRGVQRPVAITIVVVVMLIALTALVGVLAASFNEFISMLPKFNKELTRKLFKLQEMLPFLNLHMSPERMLQRMDSEKVVTFTTALMTGLSGAMASVLLLVMTVVFMLFEVRHVPYKMRFALNNPQIHIAGLHRALKGVSHYLALKTLLSLWTGVIVWLGLELMGVQFALMWAVLAFLLNYVPNIGAVISAVPPMIQVLLFNGVYECILVGALFLVVHMVIGNILEPRMMGHRLGMSTMVVFLSLLIWGWLLGPVGMLLSVPLTSVCKIWMETTKGGSKLAILLGPGRPKSRLPG

SEQ ID NO: 983 - protein, 513 aa, Escherichia coli
MPYLLEMKNITKTFGSVKAIDNVCLRLNAGEIVSLCGENGSGKSTLMKVLCGIYPHGSYEGEIIFAGEEIQASHIRDTERKGIAIIHQELALVKELTVLENIFLGNEITHNGIMDYDLMTLRCQKLLAQVSLSISPDTRVGDLGLGQQQLVEIAKALNKQVRLLILDEPTASLTEQETSILLDIIRDLQQHGIACIYISHKLNEVKAISDTICVIRDGQHIGTRDAAGMSEDDIITMMVGRELTALYPNEPHTTGDEILRIEHLTAWHPVNRHIKRVNDVSFSLKRGEILGIAGLVGAGRTETIQCLFGVWPGQWEGKIYIDGKQVDIRNCQQAIAQGIAMVPEDRKRDGIVPVMAVGKNITLAALNKFTGGISQLDDAAEQKCILESIQQLKVKTSSPDLAIGRLSGGNQQKAILARCLLLNPRILILDEPTRGIDIGAKYEIYKLINQLVQQGIAVIVISSELPEVLGLSDRVLVMHEGKLKANLINHNLTQEQVMEAALRSEHHVEKQSV

SEQ ID NO: 984 - protein, 513 aa, Escherichia coli
MRLEVFCEDRLGLTRELLDLLVLRGIDLRGIEIDPIGRIYLNFAELEFESFSSLMAEIRRIAGVTDVRTVPWMPSEREHLALSALLEALPEPVLSVDMKSKVDMANPASCQLFGQKLDRLRNHTAAQLINGFNFLRWLESEPQDSHNEHVVINGQNFLMEITPVYLQDENDQHVLTGAVVMLRSTIRMGRQLQNVAAQDVSAFSQIVAVSPKMKHVVEQAQKLAMLSAPLLITGDTGTGKDLFAYACHQASPRAGKPYLALNCASIPEDAVESELFGHAPEGKKGFFEQANGGSVLLDEIGEMSPRMQAKLLRFLNDGTFRRVGEDHEVHVDVRVICATQKNLVELVQKGMFREDLYYRLNVLTLNLPPLRDCPQDIMPLTELFVARFADEQGVPRPKLAADLNTVLTRYAWPGNVRQLKNAIYRALTQLDGYELRPQDILLPDYDAATVAVGEDAMEGSLDEITSRFERSVLTQLYRNYPSTRKLAKRLGVSHTAIANKLREYGLSQKKNEE

SEQ ID NO: 985 - protein, 245 aa, Escherichia coli
MESPTPQPAPGSATFMEGCKDSLPIVISYIPVAFAFGLNATRLGFSPLESVFFSCIIYAGASQFVITAMLAAGSSLWIAALTVMAMDVRHVLYGPSLRSRIIQRLQKSKTALWAFGLTDEVFAAATAKLVRNNRRWSENWMIGIAFSSWSSWVFGTVIGAFSGSGLLQGYPAVEAALGFMLPALFMSFLLASFQRKQSLCVTAALVGALAGVTLFSIPVAILAGIVCGCLTALIQAFWQGAPDEL

SEQ ID NO: 986 - protein, 330 aa, Escherichia coli
MKIKNILLTLCTSLLLTNVAAHAKEVKIGMAIDDLRLERWQKDRDIFVKKAESLGAKVFVQSANGNEETQMSQIENMINRGVDVLVIIPYNGQVLSNVVKEAKQEGIKVLAYDRMINDADIDFYISFDNEKVGELQAKALVDIVPQGNYFLMGGSPVDNNAKLFRAGQMKVLKPYVDSGKIKVVGDQWVDGWLPENALKIMENALTANNNKIDAVVASNDATAGGAIQALSAQGLSGKVAISGQDADLAGIKRIAAGTQTMTVYKPITLLANTAAEIAVELGNGQEPKADTTLNNGLKDVPSRLLTPIDVNKNNIKDTVIKDGFHKESEL

SEQ ID NO: 987 - protein, 124 aa, Escherichia coli
MASTARSLRYALAILTTSLVTPSVWAHAHLTHQYPAANAQVTAAPQAITLNFSEGVETGFSGAKITGPKNENIKTLPAKRNEQDQKQLIVPLADSLKPGTYTVDWHVVSVDGHKTKGHYTFSVK

SEQ ID NO: 988 - protein, 415 aa, Escherichia coli
MTDQAEKKHSAFWGVMVIAGTVIGGGMFALPVDLAGAWFFWGAFILIIAWFSMLHSGLLLLEANLNYPVGSSFNTITKDLIGNTWNIISGITVAFVLYILTYAYISANGAIISETISMNLGYHANPRIVGICTAIFVASVLWLSSLAASRITSLFLGLKIISFVIVFGSFFFQVDYSILRDATSSTAGTSYFPYIFMALPVCLASFGFHGNIPSLIICYGKRKDKLIKSVVFGSLLALVIYLFWLYCTMGNIPRESFKAIISSGGNVDSLVKSFLGTKQHGIIEFCLLVFSNLAVASSFFGVTLGLFDYLADLFKIDNSHGGRFKTVLLTFLPPALLYLIFPNGFIYGIGGAGLCATIWAVIIPAVLAIKARKKFPNQMFTVWGGNLIPAIVILFGITVILCWFGNVFNVLPKFG

SEQ ID NO: 989 - protein, 215 aa, Escherichia coli
MTAEFIIRLILAAIACGAIGMERQMRGKGAGLRTHVLIGMGSALFMIVSKYGFADVLSLDHVGLDPSRIAAQVVTGVGFIGAGNILVRNQNIVGLTTAADIWVTAAIGMVIGSGMYELGIYGSVMTLLVLEVFHQLTFRLMNKNYHLQLTLVNGNTVSMLDWFKQQKIKTDLVSLQENEDHEVVAIDIQLHATTSIEDLLRLLKGMAGVKGVSIS

SEQ ID NO: 990 - protein, 294 aa, Escherichia coli
MKKTLLAAGAVLALSSSFTVNAAENDKPQYLSDWWHQSVNVVGSYHTRFGPQIRNDTYLEYEAFAKKDWFDFYGYADAPVFFGGNSDAKGIWNHGSPLFMEIEPRFSIDKLTNTDLSFGPFKEWYFANNYIYDMGRNKDGRQSTWYMGLGTDIDTGLPMSLSMNVYAKYQWQNYGAANENEWDGYRFKIKYFVPITDLWGGQLSYIGFTNFDWGSDLGDDSGNAINGIKTRTNNSIASSHILALNYDHWHYSVVARYWHDGGQWNDDAELNFGNGNFNVRSTGWGGYLVVGYNF

SEQ ID NO: 991 - protein, 440 aa, Escherichia coli
MQATATTLDHEQEYTPINSRNKVLVASLIGTAIEFFDFYIYATAAVIVFPHIFFPQGDPTAATLQSLATFAIAFVARPIGSAVFGHFGDRVGRKATLVASLLTMGISTVVIGLLPGYATIGIFAPLLLALARFGQGLGLGGEWGGAALLATENAPPRKRALYGSFPQLGAPIGFFFANGTFLLLSWLLTDEQFMSWGWRVPFIFSAVLVIIGLYVRVSLHESPVFEKVAKAKKQVKIPLGTLLTKHVRVTVLGTFIMLATYTLFYIMTVYSMTFSTAAAPVGLGLPRNEVLWMLMMAVIGFGVMVPVAGLLADAFGRRKSMVIITTLIILFALFAFNPLLGSGNPILVFAFLLLGLSLMGLTFGPMGALLPELFPTEVRYTGASFSYNVASILGASVAPYIAAWLQTNYGLGAVGLYLAAMAGLTLIALLLTHETRHQSL

SEQ ID NO: 992 - protein, 530 aa, Escherichia coli
MLVSSNVTMQFGSKPLFENISVKFGGGNRYGLIGANGSGKSTFMKILGGDLEPTLGNVSLDPNERIGKLRQDQFAFEEFTVLDTVIMGHKELWEVKQERDRIYALPEMSEEDGYKVADLEVKYGEMDGYSAEARAGELLLGVGIPVEQHYGPMSEVAPGWKLRVLLAQALFADPDILLLDEPTNNLDIDTIRWLEQVLNERDSTMIIISHDRHFLNMVCTHMADLDYGELRVYPGNYDEYMTAATQARERLLADNAKKKAQIAELQSFVSRFSANASKSRQATSRARQIDKIKLEEVKASSRQNPFIRFEQDKKLFRNALEVEGLTKGFDNGPLFKNLNLLLEVGEKLAVLGTNGVGKSTLLKTLVGDLQPDSGTVKWSENARIGYYAQDHEYEFENDLTVFEWMSQWKQEGDDEQAVRSILGRLLFSQDDIKKPAKVLSGGEKGRMLFGKLMMQKPNILIMDEPTNHLDMESIESLNMALELYQGTLIFVSHDREFVSSLATRILEITPERVIDFSGNYEDYLRSKGIE

SEQ ID NO: 993 - protein, 405 aa, Escherichia coli
MPEPVAEPALNGLRLNLRIVSIVMFNFASYLTIGLPLAVLPGYVHDVMGFSAFWAGLVISLQYFATLLSRPHAGRYADSLGPKKIVVFGLCGCFLSGLGYLTAGLTASLPVISLLLLCLGRVILGIGQSFAGTGSTLWGVGVVGSLHIGRVISWNGIVTYGAMAMGAPLGVVFYHWGGLQALALIIMGVALVAILLAIPRPTVKASKGKPLPFRAVLGRVWLYGMALALASAGFGVIATFITLFYDAKGWDGAAFALTLFSCAFVGTRLLFPNGINRIGGLNVAMICFSVEIIGLLLVGVATMPWMAKIGVLLAGAGFSLVFPALGVVAVKAVPQQNQGAALATYTVFMDLSLGVTGPLAGLVMSWAGVPVIYLAAAGLVAIALLLTWRLKKRPPEHVPEAASSS

SEQ ID NO: 994 - protein, 463 aa, Escherichia coli
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLGVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 995 - protein, 313 aa, Escherichia coli
MAHSHSHTSSHLPEDNNARRLLYAFGVTAGFMLVEVVGGFLSGSLALLADAGHMLTDTAALLFALLAVQFSRRPPTIRHTFGWLRLTTLAAFVNAIALVVITILIVWEAIERFRTPRPVEGGMMMAIAVAGLLANILSFWLLHHGSEEKNLNVRAAALHVLGDLLGSVGAIIAALIIIWTGWTPADPILSILVSLLVLRSAWRLLKDSVNELLEGAPVSLDIAELKRRMCREIPEVRNVHHVHVWMVGEKPVMTLHVQVIPPHDHDALLDQIQHYLMDHYQIEHATIQMEYQPCHGPDCHLNEGVSGHSHHHH

SEQ ID NO: 996 - protein, 328 aa, Escherichia coli
MKLRSVTYALFIAGLAAFSTSSLAAQSLRFGYETSQTDSQHIAAKKFNDLLQERTKGELKLKLFPDSTLGNAQAMISGVRGGTIDMEMSGSNNFAGLSPVMNLLDVPFLFRDTAHAHKTLDGKVGDDLKASLEGKGLKVLAYWENGWRDVTNSRAPVKTPADLKGLKIRTNNSPMNIAAFKVFGANPIPMPFAEVYTGLETRTIDAQEHPINVVWSAKFFEVQKFLSLTHHAYSPLLVVINKAKFDGLSPEFQQALVSSAQEAGNYQRKLVAEDQQKIIDGMKEAGVEVITDLDRKAFSDALGNQVRDMFVKDVPQGADLLKAVDEVQ

SEQ ID NO: 997 - protein, 256 aa, Escherichia coli
MMHLYWVALKSIWAKEIHRFMRIWVQTLVPPVITMTLYFIIFGNLIGSRIGDMHGFSYMQFIVPGLIMMSVITNAYANVASSFFGAKFQRNIEELLVAPVPTHVIIAGYVGGGVARGLFVGILVTAISLFFVPFQVHSWVFVALTLVLTAVLFSLAGLLNGVFAKTFDDISLVPTFVLTPLTYLGGVFYSLTLLPPFWQGLSHLNPIVYMISGFRYGFLGINDVPLVTTFGVLVVFIVAFYLICWSLIQRGRGLRS

SEQ ID NO: 998 - protein, 425 aa, Escherichia coli
MAVLIFLGCLLGGIAIGLPIAWALLLCGAALMFWLDMFDVQIMAQTLVNGADSFSLLAIPFFVLAGEIMNAGGLSKRIVDLPMKLVGHKPGGLGYVGVLAAMIMASLSGSAVADTAAVAALLVPMMRSANYPVNRAAGLIASGGIIAPIIPPSIPFIIFGVSSGLSISKLFMAGIAPGMMMGATLMLTWWWQASRLNLPRQQKATMQEIWHSFVSGIWALFLPVIIIGGFRSGLFTPTEAGAVAAFYALFVATVIYREMTFATLWHVLIGAAKTTSVVMFLVASAQVSAWLITIAELPMMVSDLLQPLVDSPRLLFIVIMVAILIVGMVMDLTPTVLILTPVLMPLVKEAGIDPIYFGVMFIINCSIGLITPPIGNVLNVISGVAKLKFDDAVRGVFPYVLVLYSLLVVFVFIPDLIILPLKWIN

SEQ ID NO: 999 - protein, 477 aa, Escherichia coli
MNKKSLWKLILILAIPCIIGFMPAPAGLSELAWVLFGIYLAAIVGLVIKPFPEPVVLLIAVAASMVVVGNLSDGAFKTTAVLSGYSSGTTWLVFSAFTLSAAFVTTGLGKRIAYLLIGKIGNTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 1000 - protein, 374 aa, Escherichia coli
MRHLRNIFNLGIKELRSLLGDKAMLTLIVFSFTVSVYSSATVTPGSLNLAPIAIADMDQSQLSNRIVNSFYRPWFLPPEMITADEMDAGLDAGRYTFAINIPPNFQRDVLAGRQPDIQVNVDATRMSQAFTGNGYIQNIINGEVNSFVARYRDNSEPLVSLETRMRFNPNLDPAWFGGVMAIINNITMLAIVLTGSALIREREHGTVEHLLVMPITPFEIMMAKIWSMGLVVLVVSGLSLVLMVKGVLGVPIEGSIPLFMLGVALSLFATTSIGIFMGTIARSMPQLGLLVILVLLPLQMLSGGSTPRESMPQMVQDIMLTMPTTHFVSLAQAILYRGAGFEIVWPQFLTLMAIGGAFFTIALLRFRKTIGTMA

SEQ ID NO: 1001 - protein, 281 aa, Escherichia coli
MIENRPWLTIFSHTMLILGIAVILFPLYVAFVAATLDKQAVYAAPMTLIPGTHLLENIHNIWVNGVGTNSAPFWRMLLNSFVMAFSITLGKITVSMLSAFAIVWFRFPLRNLFFWMIFITLMLPVEVRIFPTVEVIANLQMLDSYAGLTLPLMASATATFLFRQFFMTLPDELVEAARIDGASPMRFFCDIVFPLSKTNLAALFVITFIYGWNQYLWPLLIITDVDLGTTVAGIKGMIATGEGTTEWNSVMVAMLLTLIPPVVIVLVMQRAFVRGLVDSEK

SEQ ID NO: 1002 - protein, 301 aa, Escherichia coli
MSAAGKSNPLAISGLVVLTLIWSYSWIFMKQVTSYIGAFDFTALRCIFGALVLFIVLLLRGRGMRPTPFKYTLAIALLQTCGMVGLAQWALVSGGAGKVAILSYTMPFWVVIFAALFLGERLRRGQYFAILIAAFGLFLVLQPWQLDFSSMKSAMLAILSGVSWGASAIVAKRLYARHPRVDLLSLTSWQMLYAALVMSVVALLVPQREIDWQPTVFWALAYSAILATALAWSLWLFVLKNLPASIASLSTLAVPVCGVLFSWWLLGENPGAVEGSGIVLIVLALALVSRKKKEAVSVKRI

SEQ ID NO: 1003 - protein, 341 aa, Escherichia coli
MMPQSLPDTTTPKRRFRWPTGMPQLVALLLVLLVDSLVAPHFWQVVLQDGRLFGSPIDILNRAAPVALLAIGMTLVIATGGIDLSVGAVMAIAGATTAAMTVAGFSLPIVLLSALGTGILAGLWNGILVAILKIQPFVATLILMVAGRGVAQLITAGQIVTFNSPDLSWFGSGSLLFLPTPVIIAVLTLILFWLLTRKTALGMFIEAVGINIRAAKNAGVNTRIIVMLTYVLSGLCAAIAGIIVAADIRGADANNAGLWLELDAILAVVIGGGSLMGGRFNLLLSVVGALIIQGMNTGILLSGFPPEMNQVVKAVVVLCVLIVQSQRFISLIKGVRSRDKT

SEQ ID NO: 1004 - protein, 1259 aa, Escherichia coli
MSLWKKISLGVVIVILLLLGSVAFLVGTTSGLHLVFKAADRWVPGLDIGKVTGGWRDLTLSDVRYEQPGVAVKAGNLHLAVGLECLWNSSVCINDLALKDIQVNIDSKKMPPSEQVEEEEDSGPLDLSTPYPITLTRVALDNVNIKIDDTTVSVMDFTSGLNWQEKTLTLKPTSLKGLLIALPKVAEVAQEEVVEPKIENPQPDEKPLGETLKDLFSRPVLPEMTDVHLPLNLNIEEFKGEQLRVTGDTDITVSTMLLKVSSIDGNTKLDALDIDSSQGIVNASGTAQLSDNWPVDITLNSTLNVEPLKGEKVKLKMGGALREQLEIGVNLSGPVDMDLRAQTRLAEAGLPLNVEVNSKQLYWPFTGEKQYQADDLKLKLTGKMTDYTLSMRTAVKGQEIPPATITLDAKGNEQQVNLDKLTVAALEGKTELKALLDWQQAISWRGELTLNGINTAKEFPDWPSKLNGLIKTRGSLYGGTWQMDVPELKLTGNVKQNKVNVDGTLKGNSYMQWMIPGLHLELGPNSAEVKGELGVKDLNLDATINAPGLDNALPGLGGTAKGLVKVRGTVEAPQLLADITARGLRWQELSVAQVRVEGDIKSTDQIAGKLDVRVEQISQPDVNINLVTLNAKGSEKQHELQLRIQGEPVSGQLNLAGSFDRKEERWKGTLSNTRFQTPVGPWSLTRDIALDYRNKEQKISIGPHCWLNPNAELCVPQTIDAGAEGRAVVNLNRFDLAMLKPFMPETTQASGIFTGKADVAWDTTKEGLPQGSITLSGRNVQVTQTVNDAALPVAFQTLNLTAELRNNRAELGWTIRLTNNGQFDGQVQVTDPQGRRNLGGNVNIRNFNLAMINPIFTRGEKAAGMVSANLRLGGDVQSPQLFGQLQVTGVDIDGNFMPFDMQPSQLAVNFNGMRSTLAGTVRTQQGEIYLNGDADWSQIENWRARVTAKGSKVRITVPPMVRMDVSPDVVFEATPNLFTLDGRVDVPWARIVVHDLPESAVGVSSDVVMLNDNLQPEEPKTASIPINSNLIVHVGNNVRIDAFGLKARLTGDLNVVQDKQGLGLNGQINIPEGRFHAYGQDLIVRKGELLFSGPPDQPYLNIEAIRNPDATEDDVIAGVRVTGLADEPKAEIFSDPAMSQQAALSYLLRGQGLESDQSDSAAMTSMLIGLGVAQSGQIVGKIGETFGVSNLALDTQGVGDSSQVVVSGYVLPGLQVKYGVGIFDSIATLTLRYRLMPKLYLEAVSGVDQALDLLYQFEF

SEQ ID NO: 1005 - protein, 317 aa, Escherichia coli
MSTLEPAAQSKPPGGFKLWLSQLQMKHGRKLVIALPYIWLILLFLLPFLIVFKISLAEMARAIPPYTELMEWADGQLSITLNLGNFLQLTDDPLYFDAYLQSLQVAAISTFCCLLIGYPLAWAVAHSKPSTRNILLLLVILPSWTSFLIRVYAWMGILKNNGVLNNFLLWLGVIDQPLTILHTNLAVYIGIVYAYVPFMVLPIYTALIRIDYSLVEAALDLGARPLKTFFTVIVPLTKGGIIAGSMLVFIPAVGEFVIPELLGGPDSIMIGRVLWQEFFNNRDWPVASAVAIIMLLLLIVPIMWFHKHQQKSVGEHG

SEQ ID NO: 1006 - protein, 536 aa, Escherichia coli
MATRRQPLIPGWLIPGVSATTLVVAVALAAFLALWWNAPQDDWVAVWQDSYLWHVVRFSFWQAFLSALLSVIPAIFLARALYRRRFPGRLALLRLCAMTLILPVLVAVFGILSVYGRQGWLATLCQSLGLEWTFSPYGLQGILLAHVFFNLPMASRLLLQALENIPGEQRQLAAQLGMRSWHFFRFVEWPWLRRQIPPVAALIFMLCFASFATVLSLGGGPQATTIELAIYQALSYDYDPARAAMLALLQMVCCLGLVLLSQRLSKAIAPGTTLLQGWRDPDDRLHSRICDTVLIVLALLLLLPPLLAVIVDGVNRQLPEVLAQPVLWQALWTSLRIALAAGVLCVVLTMMLLWSSRELRARQKMLAGQVLEMSGMLILAMPGIVLATGFFLLLNNTIGLPQSADGIVIFTNALMAIPYALKVLENPMRDITARYSMLCQSLGIEGWSRLKVVELRALKRPLAQALAFACVLSIGDFGVVALFGNDDFRTLPFYLYQQIGSYRSQDGAVTALILLLLCFLLFTVIEKLPGRNVKTD

SEQ ID NO: 1007 - protein, 406 aa, Escherichia coli
MFKSFFPKPGTFFLSAFVWALIAVIFWQAGGGDWVARITGASGQIPISAARFWSLDFLIFYAYYIVCVGLFALFWFIYSPHRWQYWSILGTALIIFVTWFLVEVGVAVNAWYAPFYDLIQTALSSPHKVTIEQFYREVGVFLGIALIAVVISVLNNFFVSHYVFRWRTAMNEYYMANWQQLRHIEGAAQRVQEDTMRFASTLENMGVSFINAIMTLIAFLPVLVTLSAHVPELPIIGHIPYGLVIAAIVWSLMGTGLLAVVGIKLPGLEFKNQRVEAAYRKELVYGEDDATRATPPTVRELFSAVRKNYFRLYFHYMYFNIARILYLQVDNVFGLFLLFPSIVAGTITLGLMTQITNVFGQVRGAFQYLINSWTTLVELMSIYKRLRSFEHELDGDKIQEVTHTLS

SEQ ID NO: 1008 - protein, 443 aa, Escherichia coli
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 1009 - protein, 330 aa, Escherichia coli
MPLLDIRNLTIEFKTGDEWVKAVDRVSMTLTEGEIRGLVGESGSGKSLIAKAICGVNKDNWRVTADRMRFDDIDLLRLSARERRKLVGHNVSMIFQEPQSCLDPSERVGRQLMQNIPAWTYKGRWWQRFGWRKRRAIELLHRVGIKDHKDAMRSFPYELTEGECQKVMIAIALANQPRLLIADEPTNSMEPTTQAQIFRLLTRLNQNSNTTILLISHDLQMLSQWADKINVLYCGQTVETAPSKELVTMPHHPYTQALIRAIPDFGSAMPHKSRLNTLPGAIPLLEQLPIGCRLGPRCPYAQRECIVTPRLTGAKNHLYACHFPLNMEKE

SEQ ID NO: 1010 - protein, 97 aa, Escherichia coli
MSQNATVNVDIKLGVNKFHVDEGHPHIILAENPDINEFHKLMKACPAGLYKQDDAGNIHFDSAGCLECGTCRVLCGNTILEQWQYPAGTFGIDFRYG

SEQ ID NO: 1011 - protein, 547 aa, Escherichia coli
MELLVLVWRQYRWPFISVMALSLASAALGIGLIAFINQRLIETADTSLLVLPEFLGLLLLLMAVTLGSQLALTTLGHHFVYRLRSEFIKRILDTHVERIEQLGSASLLAGLTSDVRNITIAFVRLPELVQGIILTIGSAAYLWMLSGKMLLVTAIWMAITIWGGFVLVARVYKHMATLRETEDKLYTDFQTVLEGRKELTLNRERAEYVFNNLYIPDAQEYRHHIIRADTFHLSAVNWSNIMMLGAIGLVFWMANSLGWADTNVAATYSLTLLFLRTPLLSAVGALPTLLTAQVAFNKLNKFALAPFKAEFPRPQAFPNWQTLELRNVTFAYQDNAFSVGPINLTIKRGELLFLIGGNGSGKSTLAMLLTGLYQPQSGEILLDGKPVSGEQPEDYRKLFSAVFTDVWLFDQLLGPEGKPANPQLVEKWLAQLKMAHKLELSNGRIVNLKLSKGQKKRVALLLALAEERDIILLDEWAADQDPHFRREFYQVLLPLMQEMGKTIFAISHDDHYFIHADRLLEMRNGQLSELTGEERDAASRDAVARTA

SEQ ID NO: 1012 - protein, 146 aa, Escherichia coli
MLGWVITCHDDRAQEILDALEKKHGALLQCRAVNFWRGLSSNMLSRMMCDALHEADSGEGVIFLTDIAGAPPYRVASLLSHKHSRCEVISGVTLPLIEQMMACRETMTSSEFRERIVELGAPEVSSLWHQQQKNPPFVLKHNLYEY

SEQ ID NO: 1013 - protein, 563 aa, Escherichia coli
MKTLLIIDANLGQARAYMAKTLLGAAARKAKLEIIDNPNDAEMAIVLGDSIPNDSALNGKNVWLGDISRAVAHPELFLSEAKGHAKPYTAPVAATAPVAASGPKRVVAVTACPTGVAHTFMAAEAIETEAKKRGWWVKVETRGSVGAGNAITPEEVAAADLVIVAADIEVDLAKFAGKPMYRTSTGLALKKTAQELDKAVAEATPYEPAGKAQTATTESKKESAGAYRHLLTGVSYMLPMVVAGGLCIALSFAFGIEAFKEPGTLAAALMQIGGGSAFALMVPVLAGYIAFSIADRPGLTPGLIGGMLAVSTGSGFIGGIIAGFLAGYIAKLISTQLKLPQSMEALKPILIIPLISSLVVGLAMIYLIGKPVAGILEGLTHWLQTMGTANAVLLGAILGGMMCTDMGGPVNKAAYAFGVGLLSTQTYGPMAAIMAAGMVPPLAMGLATMVARRKFDKAQQEGGKAALVLGLCFISEGAIPFAARDPMRVLPCCIVGGALTGAISMAIGAKLMAPHGGLFVLLIPGAITPVLGYLVAIIAGTLVAGLAYAFLKRPEVDAVAKAA

SEQ ID NO: 1014 - protein, 106 aa, Escherichia coli
MTKIIAVTACPSGVAHTYMAAEALESAAKAKGWEVKVETQGSIGLENELTAEDVASADMVILTKDIGIKFEERFAGKTIVRVNISDAVKRADAIMSKIEAHLAQTA

SEQ ID NO: 1015 - protein, 604 aa, Escherichia coli
MIVRILLLFIALFTFGVQAQAIKESYAFAVLGEPRYAFNFNHFDYVNPAAPKGGQITLSALGTFDNFNRYALRGNPGARTEQLYDTLFTTSDDEPGSYYPLIAESARYADDYSWVEVAINPRARFHDGSPITARDVEFTFQKFMTEGVPQFRLVYKGTTVKAIAPLTVRIELAKPGKEDMLSLFSLPVFPEKYWKDHKLSDPLATPPLASGPYRVTSWKMGQNIVYSRVKDYWAANLPVNRGRWNFDTIRYDYYLDDNVAFEAFKAGAFDLRMENDAKNWATRYTGKNFDKKYIIKDEQKNESAQDTRWLAFNIQRPVFSDRRVREAITLAFDFEWMNKALFYNAWSRTNSYFQNTEYAARNYPDAAELVLLAPMKKDLPSEVFTQIYQPPVSKGDGYDRDNLLKADKLLNEAGWVLKGQQRVNATTGQPLSFELLLPASSNSQWVLPFQHSLQRLGINMDIRKVDNSQITNRMRSRDYDMMPRVWRAMPWPSSDLQISWSSEYINSTYNAPGVQSPVIDSLINQIIAAQGNKEKLLPLGRALDRVLTWNYYMLPMWYMAEDRLAWWDKFSQPAVRPIYSLGIDTWWYDVNKAAKLPSASKQGE

SEQ ID NO: 1016 - protein, 394 aa, Escherichia coli
MTKPNHELSPALIVLMSIATGLAVASNYYAQPLLDTIARNFSLSASSAGFIVTAAQLGYAAGLLFLVPLGDMFERRRLIVSMTLLAAGGMLITASSQSLAMMILGTALTGLFSVVAQILVPLAATLASPDKRGKVVGTIMSGLLLGILLARTVAGLLANLGGWRTVFWVASVLMALMALALWRGLPQMKSETHLNYPQLLGSVFSMFISDKILRTRALLGCLTFANFSILWTSMAFLLAAPPFNYSDGVIGLFGLAGAAGALGARPAGGFADKGKSHHTTTFGLLLLLLSWLAIWFGHTSVLALIIGILVLDLTVQGVHITNQTVIYRIHPDARNRLTAGYMTSYFIGGAAGSLISASAWQHGGWAGVCLAGATIALVNLLVWWRGFHRQEAAN

SEQ ID NO: 1017 - protein, 410 aa, Escherichia coli
MQNKLASGARLGRQALLFPLCLVLYEFSTYIGNDMIQPGMLAVVEQYQAGIDWVPTSMTAYLAGGMFLQWLLGPLSDRIGRRPVMLAGVVWFIVTCLAILLAQNIEQFTLLRFLQGISLCFIGAVGYAAIQESFEEAVCIKITALMANVALIAPLLGPLVGAAWIHVLPWEGMFVLFAALAAISFFGLQRAMPETATRIGEKLSLKELGRDYKLVLKNGRFVAGALALGFVSLPLLAWIAQSPIIIITGEQLSSYEYGLLQVPIFGALIAGNLLLARLTSRRTVRSLIIMGGWPIMIGLLVAAAATVISSHAYLWMTAGLSIYAFGIGLANAGLVRLTLFASDMSKGTVSAAMGMLQMLIFTVGIEISKHAWLNGGNGLFNLFNLVNGILWLSLMVIFLKDKQMGNSHEG

SEQ ID NO: 1018 - protein, 485 aa, Escherichia coli
MAKNYAALARSVIAALGGVDNISAVTHCMTRLRFVIKDDALIDSPTLKTIPGVLGVVRSDNQCQVIIGNTVSQAFQEVVSLLPGDMQPAQPVGKPKLTLRRIGAGILDALIGTMSPLIPAIIGGSMVKLLAMILEMSGVLTKGSPTLTILNVIGDGAFFFLPLMVAASAAIKFKTNMSLAIAIAGVLVHPSFIELMAKAAQGEHVEFALIPVTAVKYTYTVIPALVMTWCLSYIERWVDSITPAVTKNFLKPMLIVLIAAPLAILLIGPIGIWIGSAISALVYTIHGYLGWLSVAIMGALWPLLVMTGMHRVFTPTIIQTIAETGKEGMVMPSEIGANLSLGGSSLAVAWKTKNPELRQTALAAAASAIMAGISEPALYGVAIRLKRPLIASLISGFICGAVAGMAGLASHSMAAPGLFTSVQFFDPANPMSIVWVFAVMALAVVLSFILTLLLGFEDIPVEEAAAQARKYQSVQPTVAKEVSLN

SEQ ID NO: 1019 - protein, 493 aa, Escherichia coli
MKKLLPILIGLSLSGFSSLSQAENLMQVYQQARLSNPELRKSAADRDAAFEKINEARSPLLPQLGLGADYTYSNGYRDANGINSNATSASLQLTQSIFDMSKWRALTLQEKAAGIQDVTYQTDQQTLILNTATAYFNVLNAIDVLSYTQAQKEAIYRQLDQTTQRFNVGLVAITDVQNARAQYDTVLANEVTARNNLDNAVEQLRQITGNYYPELAALNVENFKTDKPQPVNALLKEAEKRNLSLLQARLSQDLAREQIRQAQDGHLPTLDLTASTGISDTSYSGSKTRGAAGTQYDDSNMGQNKVGLSFSLPIYQGGMVNSQVKQAQYNFVGASEQLESAHRSVVQTVRSSFNNINASISSINAYKQAVVSAQSSLDAMEAGYSVGTRTIVDVLDATTTLYNAKQELANARYNYLINQLNIKSALGTLNEQDLLALNNALSKPVSTNPENVAPQTPEQNAIADGYAPDSPAPVVQQTSARTTTSNGHNPFRN

SEQ ID NO: 1020 - protein, 193 aa, Escherichia coli
MTDYLLLFVGTVLVNNFVLVKFLGLCPFMGVSKKLETAMGMGLATTFVMTLASICAWLIDTWILIPLNLIYLRTLAFILVIAVVVQFTEMVVRKTSPVLYRLLGIFLPLITTNCAVLGVALLNINLGHNFLQSALYGFSAAVGFSLVMVLFAAIRERLAVADVPAPFRGNAIALITAGLMSLAFMGFSGLVKL

SEQ ID NO: 1021 - protein, 337 aa, Escherichia coli
MTYAVEFDNVSRLYGDVRAVDGVSIAIKDGEFFSMLGPSGSGKTTCLRLIAGFEQLSGGAISIFGKPASNLPPWERDVNTVFQDYALFPHMSILDNVAYGLMVKGVNKKQRHAMAQEALEKVALGFVHQRKPSQLSGGQRQRVAIARALVNEPRVLLLDEPLGALDLKLREQMQLELKKLQQSLGITFIFVTHDQGEALSMSDRVAVFNNGRIEQVDSPRDLYMRPRTPFVAGFVGTSNVFDGLMAEKLCGMTGSFALRPEHIRLNTPGELQANGTIQAVQYQGAATRFELKLNGGEKLLVSQANMTGEELPATLTPGQQVMVSWSRDVMVPLVEER

SEQ ID NO: 1022 - protein, 418 aa, Escherichia coli
MSIAMRLKVMSFLQYFIWGSWLVTLGSYMINTLHFTGANVGMVYSSKGIAAIIMPGIMGIIADKWLRAERAYMLCHLVCAGVLFYAASVTDPDMMFWVMLVNAMAFMPTIALSNSVSYSCLAQAGLDPVTAFPPIRVFGTVGFIVAMWAVSLLHLELSSLQLYIASGASLLLSAYALTLPKIPVAEKKATTSLASKLGLDAFVLFKNPRMAIFFLFAMMLGAVLQITNVFGNPFLHDFARNPEFADSFVVKYPSILLSVSQMAEVGFILTIPFFLKRFGIKTVMLMSMVAWTLRFGFFAYGDPSTTGFILLLLSMIVYGCAFDFFNISGSVFVEQEVDSSIRASAQGLFMTMVNGVGAWVGSILSGMAVDYFSVDGVKDWQTIWLVFAGYALFLAVIFFFGFKYNHDPEKIKHRAVTH

SEQ ID NO: 1023 - protein, 65 aa, Escherichia coli
  MISC_FEATURE (21)...(21): Xaa is any amino acid
MIALSVCWQIVRYLCRIRQMXGLNAIEHSNYLRNYMGHLRQKLEQDPARPRHFITETGIGYRFML

SEQ ID NO: 1024 - protein, 251 aa, Escherichia coli
MTSLVSLENVSVSFGQRRVLSDVSLELKPGKILTLLGPNGAGKSTLVRVVLGLVTPDEGVIKRNGKLRIGYVPQKLYLDTTLPLTVNRFLRLRPGTHKEDILPALKRVQAGHLINAPMQKLSGGETQRVLLARALLNRPQLLVLDEPTQGVDVNGQVALYDLIDQLRRELDCGVLMVSHDLHLVMAKTDEVLCLNHHICCSGTPEVVSLHPEFISMFGPRGAEQLGIYRHHHNHRHDLQGRIVLRRGNDRS

SEQ ID NO: 1025 - protein, 92 aa, Escherichia coli
MKKILVACGTGMSTSTMIAHKLQEFLTEQGISATTAQCCLNEIPLNCNGMDLIVTSMRTNSDYGIPTLNGAALLTGINDDALKQQIKALLTQ

SEQ ID NO: 1026 - protein, 295 aa, Escherichia coli
MSSSRPVFRSRWLPYLLVAPQLIITVIFFIWPAGEALWYSLQSVDPFGFSSQFVGLDNFVTLFHDSYYLDSFWTTIKFSTFVTVSGLLVSLFFAALVEYIVRGSRFYQTLMLLPYAVAPAVAAVLWIFLFNPGRGLITHFLAEFGYDWNHAQNSGQAMFLVVFASVWKQISYNFLFFYAALQSIPRSLIEAAAIDGAGPIRRFFKIALPLIAPVSFFLLVVNLVYAFFDTFPVIDAATSGGPVQATTTLIYKIYREGFTGLDLASSAAQSVVLMFLVIVLTVVQFRYVESKVRYQ

SEQ ID NO: 1027 - protein, 326 aa, Escherichia coli
MNMEEIVALSVKHNVSDLHLCSAWPARWRIRGRMEAAPFDTPDVEELLREWLDDDQRAILLENGQLDFAVSLAENQRLRGSAFAQRHGISLALRLLPSHCPQLEQLGAPTVLPELLKSENGLILVTGATGSGKSTTLAAMVGYLNQHADAHILTLEDPVEYLYASQRCLIQQREIGLHCMTFASGLRAALREDPDVILLGELRDSETIRLALTAAETGHLVLATLHTRGAAQAVERLVDSFPAQEKDPVRNQLAGSLRAVLSQKLEVDKQEGRVALFELLINTPAVGNLIREGKTHQLPHVIQTGQQVGMITFQQSYQHRVGEGRL

SEQ ID NO: 1028 - protein, 109 aa, Escherichia coli
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLA

SEQ ID NO: 1029 - protein, 437 aa, Escherichia coli
MFDYILSLGGTVFVPIIMIVIGLIFRIPWLQAIKAGVTVGIGFVGMGLVIVMAIDSLSPPIKVMIERFGLALHVFDVGAGPASGVGYATAIGAMIIPVIFLLNVAMLVTRLTKTMNVDIYNYWHYAITGTVVQLMTGSLIYGVLGAICHAALSLKMADWTAKRVQNIVGLEGISIPQGYGSSSVPLFVLLDAIYEKIPFMKGRNIDAQEIQKRYGMVGDPVIIGVVLGLIFGLAAGEGFKGCASLMITVAAIMVLFPRMIRLIVEGLLPISDGARKFFQKYFKGREVYIGLDTAVTLGHPTTIAVGLLLIPIMLILASILPGNKVLPLADLPVAPFFICMATVIHRGDLVRTLISGVIVMITVLLIATQFAPYFTEMALKGGFSFAGESAQISALSVGNMFGWSISELMSLGIIGVVVAVGIVASVVLFLRKRELSE

SEQ ID NO: 1030 - protein, 385 aa, Escherichia coli
MTYFRINPVLALLLLLTAIAAALPFISYAPNRLVSGEGRHLWQLWPQTIWMLVGVGCAWLTACFIPGKKGSICALILAQFVFVLLVWGAGKAATQLAQNGSALARTSLGSGFWLAAALALLACSDAIRRISTHPLWRWLLHMQIAIIPLWLLYSGTLNDLSLMKEYANRQDVFDDALAQHLTLLFGAVLPALVIGVPLGIWCYFSTARQGAIFSLLNVIQTVPSVALFGLLIAPLAALVTAFPWLGTLGIAGTGMTPALIALVLYALLPLVRGVVVGLNQIPRDVLESARAMGMSGAQRFLHVQLPLALPVFLRSLRVVMVQTVGMAVIAALIGAGGFGALVFQGLLSSAIDLVLLGVIPVIVLAVLTDALFDLLIALLKVKRND

SEQ ID NO: 1031 - protein, 305 aa, Escherichia coli
MPLLKLWAGSLVMLAAVSLPLQAASPVKVGSKIDTEGALLGNIILQVLESHGVPTVNKVQLGTTPVVRGAITSGELDIYPEYTGNGAFFFKDENDAAWKNAQQGYEKVKKLDSEHNKLIWLTPAPANNTWTIAVRQDVAEKNKLTSLADLSRYLQEGGTFKLAASAEFIERADALPAFEKAYGFKLGQDQLLSLAGGDTAVTIKAAAQQTSGVNAAMAYGTDGPVAALGLQTLSDPQGVQPIYAPAPVVRESVLREYPQMAQWLQPVFASLDAKTLQQLNASIAVEGLDAKKVAADYLKQKGWTK

SEQ ID NO: 1032 - protein, 179 aa, Escherichia coli
MKQFLDFLPLVVFFAFYKIYDIYAATAALIVATAIVLIYSWVRFRKVEKMALITFVLVVVFGGLTLFFHNDEFIKWKVTVIYALFAGALLVSQWVMKKPLIQRMLGKELTLPQPVWSKLNLAWAVFFILCGLANIYIAFWLPQNIWVNFKVFGLTALTLIFTLLSGIYIYRHMPQEDKS

SEQ ID NO: 1033 - protein, 418 aa, Escherichia coli
MSGLKQELGLAQGIGLLSTSLLGTGVFAVPALAALVAGNNSLWAWPVLIILVFPIAIVFAILGRHYPSAGGVAHFVGMAFGSRLERVTGWLFLSVIPVGLPAALQIAAGFGQAMFGWHSWQLLLAELGTLALVWYIGTRGASSSANLQTVIAGLIVALIVAIWWAGDIKPANIPFPAPGNIELTGLFAALSVMFWCFVGLEAFAHLASEFKNPERDFPRALMIGLLLAGLVYWGCTVVVLHFDAYGEKMAAAASLPKIVVQLFGVGALWIACVIGYLACFASLNIYIQSFARLVWSQAQHNPDHYLARLSSRHIPNNALNAVLGCCVVSTLVIHALEINLDALIIYANGIFIMIYLLCMLAGCKLLQGRYRLLAVVGGLLCVLLLAMVGWKSLYALIMLAGLWLLLPKRKTPENGITT

SEQ ID NO: 1034 - protein, 239 aa, Escherichia coli
MTLDLPRRFPWPTLLSVCIHGAVVAGLLYTSVHQVIELPAPAQPISVTMVTPADLEPPQAVQPPPEPVVEPEPEPEPIPEPPKEAPVVIEKPKPKPKPKPKPVKKVQEQPKRDVKPVESRPASPFENTAPARLTSSTATAATSKPVTSVASGPRALSRNQPQYPARAQALRIEGQVKVKFDVTPDGRVDNVQILSAKPANMFEREVKNAMRRWRYEPGKPGSGIVVNILFKINGTTEIQ

SEQ ID NO: 1035 - protein, 149 aa, Escherichia coli
MAEIGIFVGTMYGNSLLVAEEAEAILTAQGHKATVFEDPELSDWLPYQDKYVLVVTSTTGQGDLPDSIVPLFQGIKDSLGFQPNLRYGVIALGDSSYVNFCNGGKQFDALLQEQSAQRVGEMLLIDASENPEPETESNPWVEQWGTLLS

SEQ ID NO: 1036 - protein, 393 aa, Escherichia coli
MTNSNRIKLTWISFLSYALTGALVIVTGMVMGNIADYFNLPVSSMSNTFTFLNAGILISIFLNAWLMEIVPLKTQLRFGFLLMVLAVAGLMFSHSLALFSAAMFILGVVSGITMSIGTFLVTQMYEGRQRGSRLLFTDSFFSMAGMIFPMIAAFLLARSIEWYWVYACIGLVYVAIFILTFGCEFPALGKHAPKTDAPVEKEKWGIGVLFLSVAALCYILGQLGFISWVPEYAKGLGMSLNDAGTLVSNFWMSYMVGMWAFSFILRFFDLQRILTVLAGLAAILMYVFNTGTPAHMAWSILALGFFSSAIYTTIITLGSQQTKVPSPKLVNFVLTCGTIGTMLTFVVTGPIVEHSGPQAALLTANGLYAVVFVMCFLLGFVSRHRQHNTLTSH

SEQ ID NO: 1037 - protein, 130 aa, Escherichia coli
MLYNIPCRIYILSTLSLCISGIVSTATATSSETKISNEETLVVTTNRSASNLWESPATIQVIDQQTLQNSTNASIADNLQDIPGVEITDNSLAGRKQIRIRGWICPYISRHLLSLNPLQARCRRYSRGER

SEQ ID NO: 1038 - protein, 94 aa, Escherichia coli
MKRKIIVACGGAVATSTMAAEEIKELCQNHNIPVELIQCRVNEIETYMDGVHLICTTAKVDRSFGDIPLVHGMPFISGIGIEALQNKILTILQG

SEQ ID NO: 1039 - protein, 476 aa, Escherichia coli
MAGNVQEKQLRWYNIALMSFITVWGFGNVVNNYANQGLVVVFSWVFIFALYFTPYALIVGQLGSTFKDGKGGVSTWIKHTMGPGLAYLAAWTYWVVHIPYLAQKPQAILIALGWAMKGDGSLIKEYSVVALQGLTLVLFIFFMWVASRGMKSLKIVGSVAGIAMFVMSLLYVAMAVTAPAITEVHIATTNITWETFIPHIDFTYITTISMLVFAVGGAEKISPYVNQTRNPGKEFPKGMLCLAVMVAVCAILGSLAMGMMFDSRNIPDDLMTNGQYYAFQKLGEYYNMGNTLMVIYAIANTLGQVAALVFSIDAPLKVLLGDADSKYIPASLCRTNASGTPVNGYFLTLVLVAILIMLPTLGIGDMNNLYKWLLNLNSVVMPLRYLWVFVAFIAVVRLAQKYKPEYVFIRNKPLAMTVGIWCFAFTAFACLTGIFPKMEAFTAEWTFQLALNVATPFVLVGLGLIFPLLARKANSK

SEQ ID NO: 1040 - protein, 109 aa, Escherichia coli
MSNLNPCMTCGACCAFFRVSFYWAEADDAGGTIPARLTEQISPFHRCMSGTNQKNPRCIALAGTPGKNACCTIYKNRSSTCREFAMSGENGVVNEACNRARAKYGLTPL

SEQ ID NO: 1041 - protein, 471 aa, Escherichia coli
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKAMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 1042 - protein, 635 aa, Escherichia coli
MSLISMHGAWLSFSDAPLLDNAELHIEDNERVCLVGRNGAGKSTLMKILNREQGLDDGRIIYEQDLIVARLQQDPPRNVEGSVYDFVAEGIEEQAEYLKRYHDISRLVMNDPSEKNLNELAKVQEQLDHHNLWQLENRINEVLAQLGLDPNVALSSLSGGWLRKAALGRALVSNPRVLLLDEPTNHLDIETIDWLEGFLKTFNGTIIFISHDRSFIRNMATRIVDLDRGKLVTYPGNYDQYLLEKEEALRVEELQNAEFDRKLAQEEVWIRQGIKARRTRNEGRVRALKAMRRERGERREVMGTAKMQVEEASRSGKIVFEMEDVCYQVNGKQLVKDFSAQVLRGDKIALIGPNGCGKTTLLKLMLGQLQADSGRIHVGTKLEVAYFDQHRAELDPDKTVMDNLAEGKQEVMVNGKPRHVLGYLQDFLFHPKRAMTPVRALSGGERNRLLLARLFLKPSNLLILDEPTNDLDVETLELLEELIDSYQGTVLLVSHDRQFVDNTVTECWIFEGGGKIGRYVGGYHDARGQQEQYVALKQPAVKKTEEAAAAKAETVKRSSSKLSYKLQRELEQLPQLLEDLEAKLEALQTQVADASFFSQPHEQTQKVLADMAAAEQELEQAFERWEYLEALKNGG

SEQ ID NO: 1043 - protein, 483 aa, Escherichia coli
MHFRAITRIVGLLVILFSGTMIIPGLVALIYRDGAGRAFTQTFFVALAIGSMLWWPNRKEKGELKSREGFLIVVLFWTVLGSVGALPFIFSESPNLTITDAFFESFSGLTTTGATTLVGLDSLPHAILFYRQMLQWFGGMGIIVLAVAILPILGVGGMQLYRAEMPGPLKDNKMRPRIAETAKTLWLIYVLLTVACALALWFAGMDAFDAIGHSFATIAIGGFSTHDASIGYFDSPTINTIIAIFLLISGCNYGLHFSLLSGRSLKVYWRDPEFRMFIGVQFTLVVICTLVLWFHNVYSSALMTINQAFFQVVSMATTAGFTTDSIARWPLFLPVLLLCSAFIGGCAGSTGGGLKVIRILLLFKQGNRELKRLVHPNAVYSIKLGNRALPERILEAVWGFFSAYALVFIVSMLAIIATGVDDFSAFASVVATLNNLGPGLGVVADNFTSMNPVAKWILIANMLFGRLEVFTLLVLFTPTFWRE

SEQ ID NO: 1044 - protein, 323 aa, Escherichia coli
MAQEYTVEQLNHGRKVYDFMRWDYWAFGISGLLLIAAIVIMGVRGFNWGLDFTGGTVIEITLEKPAEIDVMRDALQKAGFEEPMLQNFGSSHDIMVRMPPAEGETGGQVLGSQVLKVINESTNQNAAVKRIEFVGPSVGADLAQTGAMALMAALLSILVYVGFRFEWRLAAGVVIALAHDVIITLGILSLFHIEIDLTIVASLMSVIGYSLNDSIVVSDRIRENFRKIRRGTPYEIFNVSLTQTLHRTLITSGTTLMVILMLYLFGGPVLEGFSLTMLIGVSIGTASSIYVASALALKLGMKREHMLQQKVEKEGADQPSILP

SEQ ID NO: 1045 - protein, 443 aa, Escherichia coli
MAKQPGLDFQSAKGGLGELKRRLLFVIGALIVFRIGSFIPIPGIDAAVLAKLLEQQRGTIIEMFNMFSGGALSRASIFALGIMPYISASIIIQLLTVVHPTLAEIKKEGESGRRKISQYTRYGTLVLAIFQSIGIATGLPNMPGMQGLVINPGFAFYFTAVVSLVTGTMFLMWLGEQITERGIGNGISIIIFAGIVAGLPPAIAHTIEQARQGDLHFLVLLLVAVLVFAVTFFVVFVERGQRRIVVNYAKRQQGRRVYAAQSTHLPLKVNMAGVIPAIFASSIILFPATIASWFGGGTGWNWLTTISLYLQPGQPLYVLLYASAIIFFCFFYTALVFNPRETADNLKKSGAFVPGIRPGEQTAKYIDKVMTRLTLVGALYITFICLIPEFMRDAMKVPFYFGGTSLLIVVVVIMDFMAQVQTLMMSSQYESALKKANLKGYGR

SEQ ID NO: 1046 - protein, 393 aa, Escherichia coli
MSKSNPSEVKLAVPTSGGFSGLKSLNLQVFVMIAAIIAIMLFFTWTTDGAYLSARNVSNLLRQTAITGILAVGMVFVIISAEIDLSVGSMMGLLGGVAAICDVWLGWPLPLTIIVTLVLGLLLGAWNGWWVAYRKVPSFIVTLAGMLAFRGILIGITNGTTVSPTSAAMSQIGQSYLPASTGFIIGALGLMAFVGWQWRGRMRRQALGLQSPASTAVVGRQALTAIIVLGAIWLLNDYRGVPTPVLLLTLLLLGGMFMATRTAFGRRIYAIGGNLEAARLSGINVERTKLAVFAINGLMVAIAGLILSSRLGAGSPSAGNIAELDAIAACVIGGTSLAGGVGSVAGAVMGAFIMASLDNGMSMMDVPTFWQYIVKGAILLLAVWMDSATKRRS

SEQ ID NO: 1047 - protein, 357 aa, Escherichia coli
MAENKRTRWQRRPGTTGGKLPWNDWRNATTWRKATQLLLLAMNIYIAITFWYWVRYYETASSTTFVARPGGIEGWLPIAGLMNLKYSLVTGQLPSVHAAAMLLLVAFIVISLLLKKAFCSWLCPVGTLSELIGDLGNKLFGRQCVLPRWLDIPLRGVKYLLLSFFIYIALLMPAQAIHYFMLSPYSVVMDVKMLDFFRHMGTATLISVTVLLIASLFIRHAWCRYLCPYGALMGVVSLLSPFKIRRNAESCIDCGKCAKNCPSRIPVDKLIQVRTVECTGCMTCVESCPVASTLTFSLQKPAANKKAFALSGWLMTLLVLGIMFAVIGYAMYAGVWQSPVPEELYRRLIPQAPMIGH

SEQ ID NO: 1048 - protein, 250 aa, Escherichia coli
MSAIEVKNLVKKFHGQTVLHGIDLEVKPGEVVAIIGPSGSGKTTLLRSINLLEQPEAGTITVGDITIDTARSLSQQKSLIRQLRQHVGFVFQNFNLFPHRTVLENIIEGPVIVKGEPKEEATARARELLAKVGLAGKETSYPRRLSGGQQQRVAIARALAMRPEVILFDEPTSALDPELVGEVLNTIRQLAQEKRTMVIVTHEMSFARDVADRAIFMDQGRIVEQGAAKALFADPEQPRTRQFLEKFLLQ

SEQ ID NO: 1049 - protein, 379 aa, Escherichia coli
MMKSKMKLMPLLVSVTLISGCTVLPGSNMSTMGKDVIKQQDADFDLDKMVNVYPLTPRLIDQLRPRPNVARPNMTLESEIANYQYRVGPGDVLNVTVWDHPELTTPAGQYRSSSDTGNWVQPDGTMFYPYIGKVHVVGKTLAEIRSDITGRLATYIADPQVDVNIAAFRSQKAYISGQVNKSGQQAITNVPLTILDAINAAGGLTDTADWRNVVLTHNGREERISLQALMQNGDLNQNRLLYPGDILYVPRNDDLKVFVMGEVKKQSTLKMDFSGMTLTEALGNAEGIDMTTSNASGIFVIRPLKGEGGRNGKIANIYQLDMSDATSLVMATEFRLQPYDVVYVTTAPVSRWNRLINQLLPTISGVRYMTDTASDIHNW

SEQ ID NO: 1050 - protein, 571 aa, Escherichia coli
MNSLQILSFVGFTLLVAVITWWKVRKTDTGSQQGYFLAGRSLKAPVIAASLMLTNLSTEQLVGLSGQAYKSGMSVMGWEVTSAVTLIFLALIFLPRYLKRGIATIPDFLEERYDKTTRIIIDFCFLIATGVCFLPIVLYSGALALNSLFHVGESLQISHGAAIWLLVILLGLAGILYAVIGGLRAMAVADSINGIGLVIGGLMVPVFGLIAMGKGSFMQGIEQLTTVHAEKLNSIGGPTDPLPIGAAFTGLILVNTFYWCTNQGIVQRTLASKSLAEGQKGALLTAVLKMLDPLVLVLPGLIAFHLYQDLPKADMAYPTLVNNVLPVPMVGFFGAVLFGAVISTFNGFLNSASTLFSMGIYRRIINQNAEPQQLVTVGRKFGFFIAIVSVLVAPWIANAPQGLYSWMKQLNGIYNVPLVTIIIMGFFFPRIPALAAKVAMGIGIISYITINYLVKFDFHFLYVLACTFCINVVVMLVIGFIKPRATPFTFKDAFAVDMKPWKNVKIASIGILFAMIGVYAGLAEFGGYGTRWLAMISYFIAAVVIVYLIFDSWRHRHDPAVTFTPDGKDSL

SEQ ID NO: 1051 - protein, 438 aa, Escherichia coli
MDSTLISTRPDEGTLSLSRARRAALGSFAGAVVDWYDFLLYGITAALVFNREFFPQVSPAMGTLAAFATFGVGFLFRPLGGVIFGHFGDRLGRKRMLMLTVWMMGIATALIGILPSFSTIGWWAPILLVTLRAIQGFAVGGEWGGAALLSVESAPKNKKAFYSSGVQVGYGVGLLLSTGLVSLISMMTTDEQFLSWGWRIPFLFSIVLVLGALWVRNGMEESAEFEQQQHYQAAAKKRIPVIEALLRHPGAFLKIIALRLCELLTMYIVTAFALNYSTQNMGLPRELFLNIGLLVGGLSCLTIPCFAWLADRFGRRRVYITGTLIGTLSAFPFFMALEAQSIFWIVFFSIMLANIAHDMVVCVQQPMFTEMFGASYRYSGAGVGYQVASVVGGGFTPFIAAALITYFAGNWHSVAIYLLAGCLISAMTALLMKDSQRA

SEQ ID NO: 1052 - protein, 321 aa, Escherichia coli
MIIFTLRRILLLIVTLFLLTFVGFSLSYFTPHAPLQGASLWNAWVFWFNGLIHWDFGVSSINGQPIAEQLKEVFPATMELCILAFGFALIVGIPVGMIAGITRHKWQDNLINAIALLGFSIPVFWLALLLTLFCSLTLGWLPVSGRFDLLYEVKPITGFALIDAWLSDSPWRDEMIMSAIRHMILPVITLSVAPTTEVIRLMRISTIEVYDQNYVKAAATRGLSRFTILRRHVLHNALPPVIPRLGLQFSTMLTLAMITEMVFSWPGLGRWLINAIRQQDYAAISAGVMVCGSLVIIVNVISDILGAMANPLKHKEWYALR

SEQ ID NO: 1053 - protein, 430 aa, Escherichia coli
MKQALRVAFGFLILWASVLHAEVRIVIDSGVDSGRPIGVVPFQWAGPGAAPEDIGGIVAADLRNSGKFNPLDRARLPQQPGSAQEVQPAAWSALGIDAVVVGQVTPNPDGSYNVAYQLVDTGGAPGTVLAQNSYKVNKQWLRYAGHTASDEVFEKLTGIKGAFRTRIAYVVQTNGGQFPYELRVSDYDGYNQFVVHRSPQPLMSPAWSPDGSKLAYVTFESGRSALVIQTLANGAVRQVASFPRHNGAPAFSPDGSKLAFALSKTGSLNLYVMDLASGQIRQVTDGRSNNTEPTWFPDSQNLAFTSDQAGRPQVYKVNINGGAPQRITWEGSQNQDADVSSDGKFMVMVSSNGGQQHIAKQDLATGGVQVLSSTFLDETPSLAPNGTMVIYSSSQGMGSVLNLVSTDGRFKARLPATDGQVKFPAWSPYL

SEQ ID NO: 1054 - protein, 396 aa, Escherichia coli
MTTNTVSRKVAWLRVVTLAVAAFIFNTTEFVPVGLLSDIAQSFHMQTAQVGIMLTIYAWVVALMSLPFMLMTSQVERRKLLICLFVVFIASHVLSFLSWSFTVLVISRIGVAFAHAIFWSITASLAIRMAPAGKRAQALSLIATGTALAMVLGLPLGRIVGQYFGWRMTFFAIGIGALITLLCLIKLLPLLPSEHSGSLKSLPLLFRRPALMSIYLLTVVVVTAHYTAYSYIEPFVQNIAGFSANFATALLLLLGGAGIIGSVIFGKLGNQYASALVSTAIALLLVCLALLLPAANSEIHLGVLSIFWGIAMMIIGLGMQVKVLALAPDATDVAMALFSGIFNIGIGAGALVGNQVSLHWSMSMIGYVGAVPAFAALIWSIIIFRRWPVTLEEQTQ

SEQ ID NO: 1055 - protein, 511 aa, Escherichia coli
MATPLRYALIFLLWAMVAVIYAPLIPAALTLISPALSLTHWQALFADPQLPQALLATLVSTTIAAVGALLIALLVIVALWPGPKWQRMCARLPWLLAIPHVAFATSALLLFADGGLLYDYFPYFTPPMDRFGIGLGLTLAVKESAFLLWILAAVLSEKWLLQQVIVLDSLGYSRWQCLNWLLLPSVAPALAMAMLAIVAWSLSVVDVAIILGPGNPPTLAVISWQWLTQGDIDQQTKGALASLLLMLLLAAYVLLSYLLWRSWRRTIPRVDGVRKPATPLLPGNTLAIFLPLTGVLCVVLLAILADQSTINSEALINSLTMGLVATFIALLLLLLWLEWGPQRRQLWLWLPILLPALPLVAGQYTLALWLKLDGSWTAVVWGHLLWVMPWMLFILQPAWQRIDSRLILIAQTLGWSRAKIFFYVKCPLMLRPVLIAFAVGFAVGIAQYMPTLWLGAGRFPTLTTEAVALSSGGSNGILAAQALWQLLLPLIIFALTALVAKWVGYVRQGLR

SEQ ID NO: 1056 - protein, 476 aa, Escherichia coli
MPDFFSFINSVLWGSVMIYLLFGAGCWFTFRTGFVQFRYIRQFGKSLKNSIHPQPGGLTSFQSLCTSLAARVGSGNLAGVALAITAGGPGAVFWMWVAAFIGMATSFAECSLAQLYKERDVNGQFRGGPAWYMARGLGMRWMGVLFAVFLLIAYGIIFSGVQANAVARALSFSFDFPPLVTGIILAVFTLLAITRGLHGVARLMQGFVPLMAIIWVLTSLVICVMNIGQLPHVIWSIFESAFGWQEAAGGAAGYTLSQAITNGFQRSMFSNEAGMGSTPNAAAAAASWPPHPAAQGIVQMIGIFIDTLVICTASAMLILLAGNGTTYMPLEGIQLIQKAMRVLMGSWGAEFVTLVVILFAFSSIVANYIYAENNLFFLRLNNPKAIWCLRICTFATVIGGTLLSLPLMWQLADIIMACMAITNLTAILLLSPVVHTIASDYLRQRKLGVRPVFDPLRYPDIGRQLSPDAWDDVSQE

SEQ ID NO: 1057 - protein, 637 aa, Escherichia coli
MSSDIKIKVQSFGRFLSNMVMPNIGAFIAWGIITALFIPTGWLPNETLAKLVGPMITYLLPLLIGYTGGKLVGGERGGVVGAITTMGVIVGADMPMFLGSMIAGPLGGWCIKHFDRWVDGKIKSGFEMLVNNFSAGIIGMILAILAFLGIGPIVEALSKMLAAGVNFMVVHDMLPLASIFVEPAKILFLNNAINHGIFSPLGIQQSHELGKSIFFLIEANPGPGMGVLLAYMFFGRGSAKQSAGGAAIIHFLGGIHEIYFPYVLMNPRLILAVILGGMTGVFTLTILGGGLVSPASPGSILAVLAMTPKGAYFANIAGVCAAMAVSFVVSAILLKTSKVKEEDDIEAATRRMQDMKAESKGASPLSAGDVTNDLSHVRKIIVACDAGMGSSAMGAGVLRKKIQDAGLSQISVTNSAINNLPPDVDLVITHRDLTERAMRQVPQAQHISLTNFLDSGLYTSLTERLVAAQRHTANEEKVKDSLKDSFDDSSANLFKLGAENIFLGRKAATKEEAIRFAGEQLVKGGYVEPEYVQAMLDREKLTPTYLGESIAVPHGTVEAKDRVLKTGVVFCQYPEGVRFGEEEDDIARLVIGIAARNNEHIQVITSLTNALDDESVIERLAHTTSVDEVLELLAGRK

SEQ ID NO: 1058 - protein, 296 aa, Escherichia coli
MNMKKLATLVSAVALSATVSANAMAKDTIALVVSTLNNPFFVSLKDGAQKEADKLGYNLVVLDSQNNPAKELANVQDLTVRGTKILLINPTDSDAVGNAVKMANQANIPVITLDRQATKGEVVSHIASDNVLGGKIAGDYIAKKAGEGAKVIELQGIAGTSAARERGEGFQQAVAAHKFNVLASQPADFDRIKGLNVMQNLLTAHPDVQAVFAQNDEMALGALRALQTAGKSDVMVVGFDGTPDGEKAVNDGKLAATIAQLPDQIGAKGVETADKVLKGEKVQAKYPVDLKLVVKQ

SEQ ID NO: 1059 - protein, 491 aa, Escherichia coli
MNTQYNSSYIFSITLVATLGGLLFGYDTAVISGTVESLNTVFVAPQNLSESAANSLLGFCVASALIGCIIGGALGGYCSNRFGRRDSLKIAAVLFFISGVGSAWPELGFTSINPDNTVPVYLAGYVPEFVIYRIIGGIGVGLASMLSPMYIAELAPAHIRGKLVSFNQFAIIFGQLLVYCVNYFIARSGDASWLNTDGWRYMFASECIPALLFLMLLYTVPESPRWLMSRGKQEQAEGILRKIMGNTLATQAVQEIKHSLDHGRKTGGRLLMFGVGVIVIGVMLSIFQQFVGINVVLYYAPEVFKTLGASTDIALLQTIIVGVINLTFTVLAIMTVDKFGRKPLQIIGALGMAIGMFSLGTAFYTQAPGIVALLSMLFYVAAFAMSWGPVCWVLLSEIFPNAIRGKALAIAVAAQWLANYFVSWTFPMMDKNSWLVAHFHNGFSYWIYGCMGVLAALFMWKFVPETKGKTLEELEALWEPETKKTQQTATL

SEQ ID NO: 1060 - protein, 717 aa, Escherichia coli
MLSPLLKRYTWNSAWLYYARIFIALCGTTAFPWWLGDVKLTIPLTLGMVAAALTDLDDRLAGRLRNLIITLFCFFIASASVELLFPWPWLFAIGLTLSTSGFILLGGLGQRYATIAFGALLIAIYTMLGTSLYEHWYQQPMYLLAGAVWYNVLTLIGHLLFPVRPLQDNLARCYEQLARYLELKSRMFDPDIEDQSQAPLYDLALANGLLMATLNQTKLSLLTRLRGDRGQRGTRRTLHYYFVAQDIHERASSSHIQYQTLREHFRHSDVLFRFQRLMSMQGQACQQLSRCILLRQPYQHDPHFERAFTHIDAALERMRDNGAPADLLKTLGFLLNNLRAIDAQLATIESEQAQALPHNNDENELADDSPHGLSDIWLRLSRHFTPESALFRHAVRMSLVLCFGYAIIQITGMHHGYWILLTSLFVCQPNYNATRHRLKLRIIGTLVGIAIGIPVLWFVPSLEGQLVLLVITGVLFFAFRNVQYAHATMFITLLVLLCFNLLGEGFEVALPRVIDTLIGCAIAWAAVSYIWPDWQFRNLPRMLERATEANCRYLDAILEQYHQGRDNRLAYRIARRDAHNRDAELASVVSNMSSEPNVTPQIREAAFRLLCLNHTFTSYISALGAHREQLTNPEILAFLDDAVCYVDDALHHQPADEERVNEALASLKQRMQQLEPRADSKEPLVVQQVGLLIALLPEIGRLQRQITQVPQETPVSA

SEQ ID NO: 1061 - protein, 548 aa, Escherichia coli
MDSQRNLLVIALLFVSFMIWQAWEQDKNPQPQAQQTTQTTTTAAGSAADQGVPASGQGKLISVKTDVLDLTINTRGGDVEQALLPAYPKELNSTQPFQLLETSPQFIYQAQSGLTGRDGPDNPANGPRPLYNVEKDAYVLAEGQNELQVPMTYTDAAGNTFTKTFVLKRGDYAVNVNYNVQNAGEKPLEISSFGQLKQSITLPPHLDTGSSNFALHTFRGAAYSTPDEKYEKYKFDTIADNENLNISSKGGWVAMLQQYFATAWIPHNDGTNNFYTANLGNGIAAIGYKSQPVLVQPGQTGAMNSTLWVGPEIQDKMAAVAPHLDLTVDYGWLWFISQPLFKLLKWIHSFVGNWGFSIIIITFIVRGIMYPLTKAQYTSMAKMRMLQPKIQAMRERLGDDKQRISQEMMALYKAEKVNPLGGCFPLLIQMPIFLALYYMLMGSVELRQAPFALWIHDLSAQDPYYILPILMGVTMFFIQKMSPTTVTDPMQQKIMTFMPVIFTVFFLWFPSGLVLYYIVSNLVTIIQQQLIYRGLEKRGLHSREKKKS

SEQ ID NO: 1062 - protein, 370 aa, Escherichia coli
MVNVRQPRDVAQILLSVLFLAIMIVACLWIVQPFILGFAWAGTVVIATWPVLLRLQKIMFGRRSLAVLVMTLLLVMVFIIPIALLVNSIVDGSGPLIKAISSGDMTLPDLAWLNTIPVIGAKLYAGWHNLLDMGGTAIMAKVRPYIGTTTTWFVGQAAHIGRFMVHCALMLLFSALLYWRGEQVAQGIRHFATRLAGVRGDAAVLLAAQAIRAVALGVVVTALVQAVLGGIGLAVSGVPYATLLTVLMILSCLVQLGPLPVLIPAIIWLYWTGDTTWGTVLLVWSGVVGTLDNVIRPMLIRMGADLPLILILSGVIGGLIAFGMIGLFIGPVLLAVSWRLFAAWVEEVPPPTDQPEEILEELGEIEKPNK

SEQ ID NO: 1063 - protein, 341 aa, Escherichia coli
MSRLSPVNQARWARFRHNRRGYWSLWIFLVLFGLSLCSELIANDKPLLVRYDGSWYFPLLKNYSESDFGGPLASQADYQDPWLKQRLENNGWVLWAPIRFGATSINFATNKPFPSPPSRQNWLGTDANGGDVLARILYGTRISVLFGLMLTLCSSVMGVLAGALQGYYGGKVDLWGQRFIEVWSGMPTLFLIILLSSVVQPNFWWLLAITVLFGWMSLVGVVRAEFLRTRNFDYIRAAQALGVSDRSIILRHMLPNAMVATLTFLPFILCSSITTLTSLDFLGFGLPLGSPSLGELLLQGKNNLQAPWLGITAFLSVAILLSLLIFIGEAVRDAFDPNKAV

SEQ ID NO: 1064 - protein, 103 aa, Escherichia coli
MTNFTTSTPHDALFKTFLTHPDTARDFMEIHLPKDLRELCDLDSLKLESASFVDEKLRALHSDILWSVKTREGDGYIYVVIEHQSREDIHMAFRLMRYSMAVM

SEQ ID NO: 1065 - protein, 243 aa, Escherichia coli
MKMLRDPLFWLIALFVALIFWLPYSQPLFAALFPQLPRPVYQQESFAALALAHFWLVGISSLFAVIIGTGAGIAVTRPWGAEFRPLVETIAAVGQTFPPVAVLAIAVPVIGFGLQPAIIALILYGVLPVLQATLAGLGAIDASVTEVAKGMGMSRGQRVRKVELPLAAPVILAGVRTSVIINIGTATIASTVGASTLGTPIIIGLSGFNTAYVIQGALLVALAAIIADRLFERLVQALSQHAK

SEQ ID NO: 1066 - protein, 793 aa, Escherichia coli
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 1067 - protein, 403 aa, Escherichia coli
MKNRTLGSVFIVAGTTIGAGMLAMPLAAAGVGFSVTLILLIGLWALMCYTALLLLEVYQHVPADTGLGTLAKRYLGRYGQWLTGFSMMFLMYALTAAYISGAGELLASSISDWTGISMSATAGVLLFTFVAGGVVCVGTSLVDLFNRFLFSAKIIFLVVMLVLLLPHIHKVNLLTLPLQQGLALSAIPVIFTSFGFHGSVPSIVSYMDGNIRKLRWVFIIGSAIPLVAYIFWQVATLGSIDSTTFMGLLANHAGLNGLLQALREMVASPHVELAVHLFADLALATSFLGVALGLFDYLADLFQRSNTVGGRLQTGAITFLPPLAFALFYPRGFVMALGYAGVALAVLALIIPSLLTWQSRKHNPQAGYRVKGGRPALVVVFLCGIAVIGVQFLIAAGLLPEVG

SEQ ID NO: 1068 - protein, 221 aa, Escherichia coli
MNVFSQTQRYKALFWLSLFHLLVITSSNYLVQLPVSILGFHTTWGAFSFPFIFLATDLTVRIFGAPLARRIIFAVMIPALLISYVISSLFYMGSWQGFGALAHFNLFVARIATASFMAYALGQILDVHVFNRLRQSRRWWLAPTASTLFGNVSDTLAFFFIAFWRSPDAFMAEHWMEIALVDYCFKVLISIVFFLPMYGVLLNMLLKRLADKSEINALQAS

SEQ ID NO: 1069 - protein, 670 aa, Escherichia coli
MNASSWSLRNLPWFRATLAQWRYALRNTIAMCLALTVAYYLNLDEPYWAMTSAAVVSFPTVGGVISKSLGRIAGSLLGAIAALLLAGHTLNEPWFFLLSMSAWLGFCTWACAHFTNNVAYAFQLAGYTAAIIAFPMVNITEASQLWDIAQARVCEVIVGILCGGMMMMILPSSSDATALLTALKNMHARLLEHASLLWQPETTDAIRAAHEGVIGQILTMNLLRIQAFWSHYRFRQQNARLNALLHQQLRMTSVISSLRRMLLNWPSPPGATREILEQLLTALASSQTDVYTVARIIAPLRPTNVADYRHVAFWQRLRYFCRLYLQSSQELHRLQSGVDDHTRLPRTSGLARHTDNAEAMWSGLRTFCTLMMIGAWSIASQWDAGANALTLAAISCVLYSAVAAPFKSLSLLMRTLVLLSLFSFVVKFGLMVQISDLWQFLLFLFPLLATMQLLKLQMPKFAALWGQLIVFMGSFIAVTNPPVYDFADFLNDNLAKIVGVALAWLAFAILRPGSDARKSRRHIRALRRDFVDQLSRHPTLSESEFESLTYHHVSQLSNSQDALARRWLLRWGVVLLNCSHVVWQLRDWESRSDPLSRVRDNCISLLRGVMSERGVQQKSLAATLEELQRICDSLARHHQPAARELAAIVWRLYCSLSQLEQAPPQGTLAS

SEQ ID NO: 1070 - protein, 308 aa, Escherichia coli
MIEFSHVSKLFGAQKAVNDLNLNFQEGSFSVLIGTSGSGKSTTLKMINRLVEHDSGEIRFAGEEIRSLPVLELRRRMGYAIQSIGLFPHWSVAQNIATVPQLQKWSRARIDDRIDELMALLGLESNLRERYPHQLSGGQQQRVGVARALAADPQVLLMDEPFGALDPVTRGALQQEMTRIHRLLGRTIVLVTHDIDEALRLAEHLVLMDHGEVVQQGNPLTMLTRPANDFVRQFFGRSELGVRLLSLRSVADYVRREERADGEALAEEMTLRDALSLFVARGCEVLPVVNMQGQPCGTLHFQDLLVEA

SEQ ID NO: 1071 - protein, 543 aa, Escherichia coli
MLTLLHLLSAVALLVWGTHIVRTGVMRVFGARLRTVLSRSVEKKPLAFCAGIGVTALVQSSNATTMLVTSFVAQDLVALAPALVIVLGADVGTALMARILTFDLSWLSPLLIFIGVIFFLGRKQSRAGQLGRVGIGLGLILLALELIVQAVTPITQANGVQVIFASLTGDILLDALIGAMFAIISYSSLAAVLLTATLTAAGIISFPVALCLVIGANLGSGLLAMLNNSAANAAARRVALGSLLFKLVGSLIILPFVHLLAETMGKLSLPKAELVIYFHVFYNLVRCLVMLPFVDPMARFCKTIIRDEPELDTQLRPKHLDVSALDTPTLALANAARETLRIGDAMEQMMEGLNKVMHGEPRQEKELRKLADDINVLYTAIKLYLARMPKEELAEEESRRWAEIIEMSLNLEQASDIVERMGSEIADKSLAARRAFSLDGLKELDALYEQLLSNLKLAMSVFFSGDVTSARRLRRSKHRFRILNRRYSHAHVDRLHQQNVQSIETSSLHLGLLGDMQRLNSLFCSVAYSVLEQPDEDEGRDEY

SEQ ID NO: 1072 - protein, 360 aa, Escherichia coli
MAQLSLQHIQKIYDNQVHVVKDFNLEIADKEFIVFVGPSGCGKSTTLRMIAGLEEISGGDLLIDGKRMNDVPAKARNIAMVFQNYALYPHMTVYDNMAFGLKMQKIAKEVIDERVNWAAQILGLREYLKRKPGALSGGQRQRVALGRAIVREAGVFLMDEPLSNLDAKLRVQMRAEISKLHQKLNTTMIYVTHDQTEAMTMATRIVIMKDGIVQQVGAPKTVYNQPANMFVSGFIGSPAMNFIRGTIDGDKFVTETLKLTIPEEKLAVLKTQESLHKPIVMGIRPEDIHPDAQEENNISAKISVAELTGAEFMLYTTVGGHELVVRAGALNDYHAGENITIHFDMTKCHFFDAETEIAIR

SEQ ID NO: 1073 - protein, 219 aa, Escherichia coli
MAVIQDIIAALWQHDFAALADPHIVSVVYFVMFATLFLENGLLPASFLPGDSLLILAGALIAQGVMDFLPTIAILTAAASLGCWLSYIQGRWLGNTKTVKGWLAQLPAKYHQRATCMFDRHGLLALLAGRFLAFVRTLLPTMAGISGLPNRRFQFFNWLSGLLWVSVVTSFGYALSMIPFVKRHEDQVMTFLMILPIALLTAGLLGTLFVVIKKKYCNA

SEQ ID NO: 1074 - protein, 310 aa, Escherichia coli
MDNDKIDQHSDEIEVESEEKERGKKIEIDEDRLPSRAMAIHEHIRQDGEKELERDAMALLWSAIAAGLSMGASLLAKGIFQVELEGVPGSFLLENLGYTFGFIIVIMARQQLFTENTVTAVLPVMQKPTMSNVGLLIRLWGVVLLGNILGTGIAAWAFEYMPIFNEETRDAFVKIGMDVMKNTPSEMFANAIISGWLIATMVWMFPAAGAAKIVVIILMTWLIALGDTTHIVVGSVEILYLVFNGTLHWSDFIWPFALPTLAGNICGGTFIFALMSHAQIRNDMSNKRKAEARQKAERAENIKKNYKNPA

SEQ ID NO: 1075 - protein, 268 aa, Escherichia coli
MIETLLEVRNLSKTFRYRTGWFRRQTVEAVKPLSFTLREGQTLAIIGENGSGKSTLAKMLAGMIEPTSGELLIDDHPLHFGDYSFRSQRIRMIFQDPSTSLNPRQRISQILDFPLRLNTDLEPEQRRKQIIETMRMVGLLPDHVSYYPHMLAPGQKQRLGLARALILRPKVIIADEALASLDMSMRSQLINLMLELQEKQGISYIYVTQHIGMMKHISDQVLVMHQGEVVERGSTADVLASPLHELTKRLIAGHFGEALTADAWRKDR

SEQ ID NO: 1076 - protein, 101 aa, Escherichia coli
MTVRILAVCGNGQGSSMIMKMKVDQFLTQSNIDHTVNSCAVGEYKSELSGADIIIASTHIAGEITVTGNKYVVGVRNMLSPADFGPKLLEVIKEHFPQDVK

SEQ ID NO: 1077 - protein, 313 aa, Escherichia coli
MAMNVLQSPSRPGLGKVSGFFWHNPGLGLFLLLLGPLMWFGIVYFGSLLTLLWQGFYTFDDFTMSVTPELTLANIRALFNPANYDIILRTLTMAVAVTIASAILAFPMAWYMARYTSGKMKAFFYIAVMLPMWASYIVKAYAWTLLLAKDGVAQWFLQHLGLEPLLTAFLTLPAVGGNTLSTSGLGRFLVFLYIWLPFMILPVQAALERLPPSLLQASADLGARPRQTFRYVVLPLAIPGIAAGSIFTFSLTLGDFIVPQLVGPPGYFIGNMVYSQQGAIGNMPMAAAFTLVPIILIALYLAFVKRLGAFDAL

SEQ ID NO: 1078 - protein, 372 aa, Escherichia coli
MSLPFLRTLQGDRFFQLLILVGIGLSFFVPFAPKSWPAAIDWHTIITLSGLMLLTKGVELSGYFDVLGRKMVRRFATERRLAMFMVLAAALLSTFLTNDVALFIVVPLTITLKRLCEIPVNRLIIFEALAVNAGSLLTPIGNPQNILIWGRSGLSFAGFIAQMAPLAGAMMLTLLLLCWCCFPGKAMQYHTGVQTPEWKPRLVWSCLGLYIVFLTALEFKQELWGLVIVAAGFALLARRVVLSVDWTLLLVFMAMFIDVHLLTQLPALQGVLGNVSHLSEPGLWLTAIGLSQVISNVPSTILLLNYVPPSLLLVWAVNVGGFGLLPGSLANLIALRMANDRRIWWRFHLYSIPMLLWAALVGYVLLVILPAN

SEQ ID NO: 1079 - protein, 402 aa, Escherichia coli
MTVNSSRNALKRRTWALFMFFFLPGLLMASWATRTPAIRDILSVSIAEMGGVLFGLSIGSMSGILCSAWLVKRFGTRNVILVTMSCALIGMMILSLALWLTSPLLFAVGLGVFGASFGSAEVAINVEGAAVEREMNKTVLPMMHGFYSLGTLAGAGVGMALTAFGVPATVHILLAALVGIAPIYIAIQAIPDGTGKNAADGTQHGEKGVPFYRDIQLLLIGVVVLAMAFAEGSANDWLPLLMVDGHGFSPTSGSLIYAGFTLGMTVGRFTGGWFIDRYSRVAVVRASALMGALGIGLIIFVDSAWVAGVSVVLWGLGASLGFPLTISAASDTGPDAPTRVSVVATTGYLAFLVGPPLLGYLGEHYGLRSAMLVVLALVILAAIVAKAVAKPDTKTQTAMENS

SEQ ID NO: 1080 - protein, 385 aa, Escherichia coli
MERNVTLDFVRGVAILGILLLNISAFGLPKAAYLNPAWYGAITPRDAWTWAFLDLIGQVKFLTLFALLFGAGLQMLLPRGRRWIQSRLTLLVLLGFIHGLLFWDGDILLAYGLVGLICWRLVRDAPSVKSLFNTGVMLYLVGLGVLLLLGLISDSQTSRAWTPDASAILYEKYWKLHGGVEAISNRADGVGNSLLALGAQYGWQLAGMMLIGAALMRSGWLKGQFSLRHYRRTGFVLVAIGVTINLPAIALQWQLDWAYRWCAFLLQMPRELSAPFQAIGYASLFYGFWPQLSRFKLVLAIACVGRMALTNYLLQTLICTTLFYHLGLFMHFDRLELLAFVIPVWLANILFSVIWLRYFRQGPVEWLWRQLTLRAAGPAISKTSR

SEQ ID NO: 1081 - protein, 264 aa, Escherichia coli
MHSERAPFFLKLAAWGGVVFLHFPILIIAAYAFNTEDAAFSFPPQGLTLRWFSVAAQRSDILDAVTLSLKVAALATLIALVLGTLAAAALWRRDFFGKNAISLLLLLPIALPGIVTGLALLTAFKTINLEPGFFTIVVGHATFCVVVVFNNVIARFRRTSWSLVEASMDLGANGWQTFRYVVLPNLSSALLAGGMLAFALSFDEIIVTTFTAGHERTLPLWLLNQLGRPRDVPVTNVVALLVMLVTTLPILGAWWLTREGDNGQ

SEQ ID NO: 1082 - protein, 284 aa, Escherichia coli
MGNGWHEWPLVIFTVLGQCVVGALIVSGIGWFAAKNDADRQRIVRGMFFLWLLMGVGFIASVMHLGSPLRAFNSLNRIGASGLSNEIAAGSIFFAVGGLWWLVAVIGKMPQALGKLWLLFSMALGVIFVWMMTCVYQIDTVPTWHNGYTTLAFFLTVLLSGPILAAAILRAARVTFNTTPFAIISVLALIACAGVIVLQGLSLASIHSSVQQASALVPDYASLQVWRVVLLCAGLGCWLCPLIRRREPHVAGLILGLILILGGEMIGRVLFYGLHMTVGMAIAG

SEQ ID NO: 1083 - protein, 217 aa, Escherichia coli
MLCVKNVSLRLPESRLLTNVNFTVDKGDIVTLMGPSGCGKSTLFSWMIGALAEQFSCTGELWLNEQRIDILPTAQRQIGILFQDALLFDQFSVGQNLLLALPATLKGNARRNAVNDALERSGLEGAFHQDPATLSGGQRARVALLRALLAQPKALLLDEPFSRLDVALRDNFRQWVFSEVRALAIPVVQVTHDLQDVPADSSVLDMAQWSENYNKLR

SEQ ID NO: 1084 - protein, 415 aa, Escherichia coli
MQDLISQVEDLAGIEIDHTTSMVMIFGIIFLTAVVVHIILHWVVLRTFEKRAIASSRLWLQIITQNKLFHRLAFTLQGIIVNIQAVFWLQKGTEAADILTTCAQLWIMMYALLSVFSLLDVILNLAQKFPAASQLPLKGIFQGIKLIGAILVGILMISLLIGQSPAILISGLGAMAAVLMLVFKDPILGLVAGIQLSANDMLKLGDWLEMPKYGADGAVIDIGLTTVKVRNWDNTITTIPTWSLVSDSFKNWSGMSASGGRRIKRSISIDVTSIRFLDEDEMQRLNKAHLLKPYLTSRHQEINEWNRQQGSTESVLNLRRMTNIGTFRAYLNEYLRNHPRIRKDMTLMVRQLAPGDNGLPLEIYAFTNTVVWLEYESIQADIFDHIFAIVEEFGLRLHQSPTGNDIRSLAGAFKQ

SEQ ID NO: 1085 - protein, 109 aa, Escherichia coli
MAQFEWVHAAWLALAIVLEIVANVFLKFSDGFRRKIFGLLSLAAVLAAFSALSQAVKGIDLSVAYALWGGFGIAATLAAGWILFGQRLNRKGWIGLVLLLAGMIMVKLA

SEQ ID NO: 1086 - protein, 327 aa, Escherichia coli
MNNEQRGVALLIVLMLLALMAALAADMTLSFHSQLQRTRQVNHHLQRQYDIELAEKLALASLTQDVKDNDRQTTLQQYWAQPQQLQLEDGNTVKWQLRDAQHCFNLNALAKISDDPLASPDFPAQVFSALLINAGIDRGNTDEIVQSIADYIDVDDSPRFHGAEDSFYQSQTPPRHSANQMLFLTGELRQIKGITENIYQRLIPYVCVLPTTELSINLNMLTENDIPLFRALFLNNITDADARVLLQKRPREGWLTTDAFLYWAQQDFSGVKPLVAQVKRHLFPYSRYFTLSTESISDEQSQGWQSHIFFNRKQQSAQIYRRTLQLY

SEQ ID NO: 1087 - protein, 501 aa, Escherichia coli
MEALLQLKGIDKAFPGVKALSGAALNVYPGRVMALVGENGAGKSTMMKVLTGIYTRDAGTLLWLGKETTFTGPKSSQEAGIGIIHQELNLIPQLTIAENIFLGREFVNRFGKIDWKTMYAEADKLLAKLNLRFKSDKLVGDLSIGDQQMVEIAKVLSFESKVIIMDEPTDALTDTETESLFRVIRELKSQGRGIVYISHRMKEIFEICDDVTVFRDGQFIAEREVASLTEDSLIEMMVGRKLEDQYPHLDKAPGDIRLKVDNLCGPGVNDVSFTLRKGEILGVSGLMGAGRTELMKVLYGALPRTSGYVTLDGHEVVTRSPQDGLANGIVYISEDRKRDGLVLGMSVKENMSLTALRYFSRAGGSLKHADEQQAVSDFIRLFNVKTPSMEQAIGLLSGGNQQKVAIARGLMTRPKVLILDEPTRGVDVGAKKEIYQLINQFKADGLSIILVSSEMPEVLGMSDRIIVMHEGHLSGEFTREQATQEVLMAAAVGKLNRVNQE

SEQ ID NO: 1088 - protein, 206 aa, Escherichia coli
MSYTLPSLPYAYDALEPHFDKQTMEIHHTKHHQTYVNNANAALESLPEFANLPVEELITKLDQLPADKKTVLRNNAGGHANHSLFWKGLKKGTTLQGDLKAAIERDFGSVDNFKAEFEKAAASRFGSGWAWLVLKGDKLAVVSTANQDSPLMGEAISGASGFPIMGLDVWEHAYYLKFQNRRPDYIKEFWNVVNWDEAAARFAAKK

SEQ ID NO: 1089 - protein, 254 aa, Escherichia coli
MKIITCFKLVPEEQDIVVTPEYTLNFDNADAKISQFDLNAIEAASQLATDDDEIAALTVGGSLLQNSKVRKDVLSRGPHSLYLVQDAQLEHALPLDTAKALAAAIEKIGFDLLIFGEGSGDLYAQQVGLLVGEILQLPVINAVSAIQRQGNTLVIERTLEDDVEVIELSVPAVLCVTSDINVPRIPSMKAILGAGKKPVNQWQASDIDWSQSAPLAELVGIRVPPQTERKHIIIDNDSPEAIAELAEHLKKALN

SEQ ID NO: 1090 - protein, 405 aa, Escherichia coli
MATAWYKQVNPPQRKALFSAWLGYVFDGFDFMMIFYILHIIKADLGITDIQATLIGTVAFIARPIGGGFFGAMADKYGRKPMMMWAIFIYSVGTGLSGIATNLYMLAVCRFIVGLGMSGEYACASTYAVESWPKNLQSKASAFLVSGFSVGNIIAAQIIPQFAEVYGWRNSFFIGLLPVLLVLWIRKSAPESQEWIEDKYKDKSTFLSVFRKPHLSISMIVFLVCFCLFGANWPINGLLPSYLADNGVNTVVISTLMTIAGLGTLTGTIFFGFVGDKIGVKKAFVVGLITSFIFLCPLFFISVKNSSLIGLCLFGLMFTNLGIAGLVPKFIYDYFPTKLRGLGTGLIYNLGATGGMAAPVLATYISGYYGLGVSLFIVTVAFSALLILLVGFDIPGKIYKLSVAK

SEQ ID NO: 1091 - protein, 449 aa, Escherichia coli
MPLIIVVAGIALLLLLTIKIKLNTFVSLIIVSIAVAIASGMDLSKVVTSVESGLGGTLGHIGLIFGFGVMLGRLLADAGGAQRIALTMLNYFGKNKLDWAVVCSAFIVGIALFFEVGLILLVPILFAIAREAKISPMFMCVPMLSGLLVAHGFLPPHPGPTVIAREYGADVGLVLIYGIIVGIPTFILCGPVLNKFCQRIIPDAFKKEGNIASLGATRRFSESEMPGFGISFLTAMLPVILMAVVTIIQMTHAKSAADSGLFYNVILFLGNSTIAMLISLLFAIYTMGLGRGKTIPDLMDSCGKAIAGIAGLLLIIGGGGAFKQVLIDSGVGQYISTLVSGMDINPILMAWGVAAFLRICLGSATVAAISTAGLVIPLLAVHPNTNLALITLATGAGSCICSHVNDASFWMIKDFFGLTTKETLLSWTLMSTLLSISGLIFILLASLVL

SEQ ID NO: 1092 - protein, 231 aa, Escherichia coli
MSEIKDVIVQGLWKNNSALVQLLGLCPLLAVTSTATNALGLGLATTLVLTLTNLTISTLRHWTPAEIRIPIYVMIIASVVSAVQMLINAYAFGLYQSLGIFIPLIVTNCIVVGRAEAFAAKKGPALSALDGFSIGMGATCAMFVLGSLREIIGNGTLFDGADALLGSWAKVLRVEIFHTDSPFLLAMLPPGAFIGLGLMLAGKYLIDERMKKRRAEAAAERALPNGETGNV

SEQ ID NO: 1093 - protein, 740 aa, Escherichia coli
MLKLFSAFRKNKIWDFNGGIHPPEMKTQSNGTPLRQVPLAQRFVIPLKQHIGAEGELCVSVGDKVLRGQPLTRGRGKMLPVHAPTSGTVTAIAPHSTAHPSALAELSVIIDADGEDCWIPRDGWADYRTRSREELIERIHQFGVAGLGGAGFPTGVKLQGGGDKIETLIINAAECEPYITADDRLMQDCAAQVVEGIRILAHILQPREILIGIEDNKPQAISMLRAVLADSNDISLRVIPTKYPSGGAKQLTYILTGKQVPHGGRSSDIGVLMQNVGTAYAVKRAVIDGEPITERVVTLTGEAIARPGNVWARLGTPVRHLLNDAGFCPSADQMVIMGGPLMGFTLPWLDVPVVKITNCLLAPSANELGEPQEEQSCIRCSACADACPADLLPQQLYWFSKGQQHDKATTHNIADCIECGACAWVCPSNIPLVQYFRQEKAEIAAIRQEEKRAAEAKARFEARQARLEREKAARLERHKSAAVQPAAKDKDAIAAALARVKEKQAQATQPIVIKAGERPDNSAIIAAREARKAQARAKQAELQQTNDAATVADPRKTAVEAAIARAKARKLEQQQANAEPEQQVDPRKAAVEAAIARAKARKLEQQQANAEPEEQVDPRKAAVEAAIARAKARKLEQQQANAEPEQQVDPRKAAVEAAIARAKARKREQQPANAEPEEQVDPRKAAVEAAIARAKARKLEQQQANAVPEEQVDPRKAAVAAAIARAQAKKAAQQKVVNED

SEQ ID NO: 1094 - protein, 296 aa, Escherichia coli
MPYDSVYSEKRPPGTLRTAWRKFYSDASAMVGLYGCAGLAVLCIFGGWFAPYGIDQQFLGYQLLPPSWSRYGEVSFFLGTDDLGRDVLSRLLSGAAPTVGGAFVVTLAATICGLVLGTFAGATHGLRSAVLNHILDTLLAIPSLLLAIIVVAFAGPSLSHAMFAVWLALLPRMVRSIYSMVHDELEKEYVIAARLDGASTLNILWFAVMPNITAGLVTEITRALSMAILDIAALGFLDLGAQLPSPEWGAMLGDALELIYVAPWTVMLPGAAIMISVLLVNLLGDGVRRAIIAGVE

SEQ ID NO: 1095 - protein, 312 aa, Escherichia coli
MSQLNSVWVFSDNPERYAELFGGAQQWGQQVYAIVQNTDQAQAVMPYGPKCLYVLAQNDALQRTENYAESIAALLKDKHPAMLLLAATKRGKALAARLSVQLNAALVNDATAVDIVDGHICAEHRMYGGLAFAQEKINSPLAIITLAPGVQEPCTSDTSHQCPTETVPYVAPRHEILCRERRAKAASSVDLSKAKRVVGVGRGLAAQDDLKMVHELAAVLNAEVGCSRPIAEGENWMERERYIGVSGVLLKSDLYLTLGISGQIQHMVGGNGAKVIVAINKDKNAPIFNYADYGLVGDIYKVVPALISQLSR

SEQ ID NO: 1096 - protein, 188 aa, Escherichia coli
MGNTKLANPAPLGLMGFGMTTILLNLHNVGYFALDGIILAMGIFYGGIAQIFAGLLEYKKGNTFGLTAFTSYGSFWLTLVAILLMPKLGLTDAPNAQFLGVYLGLWGVFTLFMFFGTLKGARVLQFVFFSLTVLFALLAIGNIAGNAAIIHFAGWIGLICGASAIYLAMGEVLNEQFGRTVLPIGESH

SEQ ID NO: 1097 - protein, 382 aa, Escherichia coli
MSTYTQPVMLLLSGLLLLTLAIAVLNTLVPLWLAQEHMSTWQVGVVSSSYFTGNLVGTLLTGYVIKRIGFNRSYYLASFIFAAGCAGLGLMIGFWSWLAWRFVAGVGCAMIWVVVESALMCSGTSRNRGRLLAAYMMVYYVGTFLGQLLVSKVSTELMSVLPWVTGLTLAGILPLLFTRVLNQQAENHDSTSITSMLKLRQARLGVNGCIISGIVLGSLYGLMPLYLNHKGVSNASIGFWMAVLVSAGILGQWPIGRLADKFGRLLVLRVQVFVVILGSIAMLSQAAMAPALFILGAAGFTLYPVAMAWACEKVEHHQLVAMNQALLLSYTVGSLLGPSFTAMLMQNFSDNLLFIMIASVSFIYLLMLLRNAGHTPKPVAHV

SEQ ID NO: 1098 - protein, 1174 aa, Escherichia coli
MITIDGNGAVASVAFRTSEVIAIYPITPSSTMAEQADAWAGNGLKNVWGDTPRVVEMQSEAGAIATVHGALQTGALSTSFTSSQGLLLMIPTLYKLAGELTPFVLHVAARTVATHALSIFGDHSDVMAVRQTGCAMLCAANVQEAQDFALISQIATLKSRVPFIHFFDGFRTSHEINKIVPLADDTILDLMPQVEIDAHRARALNPEHPVIRGTSANPDTYFQSREATNPWYNAVYDHVEQAMNDFSAATGRQYQPFEYYGHPQAERVIILMGSAIGTCEEVVDELLTRGEKVGVLKVRLYRPFSAKHLLQALPGSVRSVAVLDRTKEPGAQAEPLYLDVMTALAEAFNNGERETLPRVIGGRYGLSSKEFGPDCVLAVFAELNAAKPKARFTVGIYDDVTNLSLPLPENTLPNSAKLEALFYGLGSDGSVSATKNNIKIIGNSTPWYAQGYFVYDSKKAGGLTVSHLRVSEQPIRSAYLISQADFVGCHQLQFIDKYQMAERLKPGGIFLLNTPYSADEVWSRLPQEVQAVLNQKKARFYVINAAKIARECGLAARINTVMQMAFFHLTQILPGDSALAELQGAIAKSYSSKGQDLVERNWQALALARESVEEVPLQPVNPHSANRPPVVSDAAPDFVKTVTAAMLAGLGDALPVSALPPDGTWPMGTTRWEKRNIAEEIPIWKEELCTQCNHCVAACPHSAIRAKVVPPEAMENAPASLHSLDVKSRDMRGQKYVLQVAPEDCTGCNLCVEVCPAKDRQNPEIKAINMMSRLEHVEEEKINYDFFLNLPEIDRSKLERIDIRTSQLITPLFEYSGACSGCGETPYIKLLTQLYGDRMLIANATGCSSIYGGNLPSTPYTTDANGRGPAWANSLFEDNAEFGLGFRLTVDQHRVRVLRLLDQFADKIPAELLTALKSDATPEVRREQVAALRQQLNDVAEAHELLRDADALVEKSIWLIGGDGWAYDIGFGGLDHVLSLTENVNILVLDTQCYSNTGGQASKATPLGAVTKFGEHGKRKARKDLGVSMMMYGHVYVAQISLGAQLNQTVKAIQEAEAYPGPSLIIAYSPCEEHGYDLALSHDQMRQLTATGFWPLYRFDPRRADEGKLPLALDSRPPSEAPEETLLHEQRFRRLNSQQPEVAEQLWKDAAADLQKRYDFLAQMAGKAEKSNTD

SEQ ID NO: 1099 - protein, 483 aa, Escherichia coli
MESSLRIVAITNCPAGIAHTYMVAEALEQKARSLGHTIKVETQGSSGVENRLSSEEIAAADYVILATGRGLSGDDRARFAGKKVYEIAISQALKNIDQIFSELPTNSQLFAADSGVKLGKQEVQSGSVMSHLMAGVSAALPFVIGGGILVALANMLVQFGLPYTDMSKGAPSFTWVVESIGYLGFTFMIPIMGAYIASSIADKPAFAPAFLVCYLANDKALLGTQSGAGFLGAVVLGLAIGYFVFWFRKVRLGKALQPLLGSMLIPFVTLLVFGVLTYYVIGPVMSDLMGGLLHFLNTIPPSMKFAAAFLVGAMLAFDMGGPINKTAWFFCFSLLEKHIYDWYAIVGVVALMPPVAAGLATFIAPKLFTRQEKEAASSAIVVGATVATEPAIPYALAAPLPMITANTLAGGITGVLVIAFGIKRLAPGLGIFDPLIGLMSPVGSFYLVLAIGLALNISFIIVLKGLWLRRKAKAAQQELVHEH

SEQ ID NO: 1100 - protein, 474 aa, Escherichia coli
MAKEISSELLNTILTRVGGPGNIASCGNCMTRLRLGVHDSSLVDPNIKTLEGVKGVILTSDQVQVVFGPGKAHRAAKAMSELLGEAPVQDAAEIAAQNKRQLKAKQTSGVQQFLAKFATIFTPLIPGFIAAGLLLGIATLIATVMHVPADAQGTLPDALNFMKVFSKGLFTFLVILVGYNAAQAFGGTGVNGAIIAALFLLGYNPAATTGYYAGFHDFFGLPIDPRGNIIGVLIAAWACARIEGMVRRFMPDDLDMLLTSLITLLITATLAYLIIMPLGGWLFEGMSWLFMHLNSNPFGCAVLAGLFLIAVVFGVHQGFIPVYLALMDSQGFNSLFPILSMAGAGQVGAALALYWRAQPHSALRSQVRGAIIPGLLGVGEPLIYGVTLPRMKPFVTACLGGAAGGLFIGLIAWWGLPMGLNSAFGPSGLVALPLMTSAQGILPAMAVYAGGILVAWVCGFIFTTLFGCRNVNLD

SEQ ID NO: 1101 - protein, 416 aa, Escherichia coli
MDIMRSVVGMVVLLAIAFLLSVNKKSISLRTVGAALLLQIAIGGIMLYFPPGKWAVEQAALGVHKVMSYSDAGSAFIFGSLVGPKMDVLFDGAGFIFAFRVLPAIIFVTALISLLYYIGVMGLLIRILGSIFQKALNISKIESFVAVTTIFLGQNEIPAIVKPFIDRMNRNELFTAICSGMASIAGSMMIGYAGMGVPIDYLLAASLMAIPGGILFARILSPATEPSQVTFENLSFSETPPKSFIEAAASGAMTGLKIAAGVATVVMAFVAIIALINGIIGGIGGWFGFANASLESIFGYVLAPLAWIMGVDWSDANLAGSLIGQKLAINEFVAYLSFSPYLQTGGTLEVKTIAIISFALCGFANFGSIGVVVGAFSAISPKRAPEIAQLGLRALAAATLSNLMSATIAGFFIGLA

SEQ ID NO: 1102 - protein, 84 aa, Escherichia coli
MARVTLRITGTQLLCQDEHPSLLAALESHNVAVEYQCREGYCGSCRTRLVAGQVDWIAEPLAFIQPGEILPCCCRAKGDIEIEM

SEQ ID NO: 1103 - protein, 261 aa, Escherichia coli
MNPSQHAEQFQSQLANYVPQFTPEFWPVWLIIAGVLLVGMWLVLGLHALLRARGVKKSATDHGEKIYLYSKAVRLWHWSNALLFVLLLASGLINHFAMVGATAVKSLVAVHEVCGFLLLACWLGFVLINAVGDNGHHYRIRRQGWLERAAKQTRFYLFGIMQGEEHPFPATTQSKFNPLQQVAYVGVMYGLLPLLLLTGLLCLYPQAVGDVFPGVRYWLLQTHFALAFISLFFIFGHLYLCTTGRTPHETFKSMVDGYHRH

SEQ ID NO: 1104 - protein, 610 aa, Escherichia coli
MNGELIWVLSLLAVAIVLFATGRVRMDAVALFVIVAFALSGTLTVPEVFSGFSDPNVVLIAALFIIGDGLVRTGVATVMGTWLVKVAGNSEIKMLVLLMLTVAGLGAFMSSTGVVAIFIPVVLSVAMRMQTSPSRLMMPLSFAGLISGMMTLVATPPNLVVNSELLREGYHGFSFFSVTPIGLVVLVLGILYMLVMRFMLKGDTQTPQREGWTRRTFRDLIREYRLTGRARRLAIRPGSPMIGQRLDDLKLRERYGANVIGVERWRRFRRVIVNVNGVSEFRARDVLLIDMSAADVDLRQFCSEQLLEPMVLRGEYFSDQALDVGMAEISLIPESELIGKSVREIGFRTRYGLNVVGLKRNGVALEGSLADEPLLLGDIILVVGNWKLIGMLAKQGRDFVALNLPEEVSEASPAHSQAPHAIFCLVLMVALMLTDEIPNPVAAIIACLLMGKFRCIDAESAYKSIHWPSIILIVGMMPFAVALQKTGGVALAVKGLMDIGGGYGPHMMLGCLFVLSAVIGLFISNTATAVLMAPIALAAAKTMGVSPYPFAMVVAMAASAAFMTPVSSPVNTLVLGPGNYSFSDFVKLGVPFTIIVMAVCVVMIPMLFPF

SEQ ID NO: 1105 - protein, 364 aa, Escherichia coli
MGAYLIRRLLLVIPTLWAIITINFFIVQIAPGGPVDQAIAAIEFGNAGVLPGAGGEGVRASHAQTGVGNISDSNYRGGRGLDPEVIAEITHRYGFDKPIHERYFKMLWDYIRFDFGDSLFRSASVLTLIKDSLPVSITLGLWSTLIIYLVSIPLGIRKAVYNGSRFDVWSSAFIIIGYAIPAFLFAILLIVFFAGGSYFDLFPLRGLVSANFDSLPWYQKITDYLWHITLPVLATVIGGFAALTMLTKNSFLDEVRKQYVVTARAKGVSEKNILWKHVFRNAMLLVIAGFPATFISMFFTGSLLIEVMFSLNGLGLLGYEATVSRDYPVMFGTLYIFTLIGLLLNIVSDISYTLVDPRIDFEGR

SEQ ID NO: 1106 - protein, 510 aa, Escherichia coli
MRIGIPRERLTNETRVAATPKTVEQLLKLGFTVAVESGAGQLASFDDKAFVQAGAEIVEGNSVWQSEIILKVNAPLDDEIALLNPGTTLVSFIWPAQNPELMQKLAERNVTVMAMDSVPRISRAQSLDALSSMANIAGYRAIVEAAHEFGRFFTGQITAAGKVPPAKVMVIGAGVAGLAAIGAANSLGAIVRAFDTRPEVKEQVQSMGAEFLELDFKEEAGSGDGYAKVMSDAFIKAEMELFAAQAKEVDIIVTTALIPGKPAPKLITREMVDSMKAGSVIVDLAAQNGGNCEYTVPGEIFTTENGVKVIGYTDLPGRLPTQSSQLYGTNLVNLLKLLCKEKDGNITVDFDDVVIRGVTVIRAGEITWPAPPIQVSAQPQAAQKAAPEVKTEEKCTCSPWRKYALMALAIILFGWMASVAPKEFLGHFTVFALACVVGYYVVWNVSHALHTPLMSVTNAISGIIVVGALLQIGQGGWVSFLSFIAVLIASINIFGGFTVTQRMLKMFRKN

SEQ ID NO: 1107 - protein, 462 aa, Escherichia coli
MENKSARAKVQAFGGFLTAMVIPNIGAFIAWGFITALFIPTGWLPNEHFAKIVGPMITYLLPVMIGSTGGHLVGGKRGAVMGGIGTIGVIVGAEIPMFLGSMIMGPLGGLVIKYVDKALEKRIPAGFEMVINNFSLGIAGMLLCLLGFEVIGPAVLIANTFVKECIEALVHAGYLPLLSVINEPAKVLFLNNAIDQGVYYPLGMQQASVNGKSIFFMVASNPGPGLGLLLAFTLFGKGMSKRSAPGAMIIHFLGGIHELYFPYVLMKPLTIIAMIAGGMSGTWMFNLLDGGLVAGPSPGSIFAYLALTPKGSFLATIAGVTVGTLVSFAITSLILKMEKTVETESEDEFAQSANAVKAMKQEGAFSLSRVKRIAFVCDAGMGSSAMGATTFRKRLEKAGLAIEVKHYAIENVPADADIVVTHASLEGRVKRVTDKPLILINNYIGDPKLDTLFNQLTAEHKH

SEQ ID NO: 1108 - protein, 206 aa, Escherichia coli
MLKTIRKHGITLALFAAGSTGLTAAINQMTKTTIAEQASLQQKALFDQVLPAERYNNALAQSCYLVTAPELGKGEHRVYIAKQDDKPVAAVLEATAPDGYSGAIQLLVGADFNGTVLGTRVTEHHETPGLGDKIELRLSDWITHFAGKKISGADDAHWAVKKDGGDFDQFTGATITPRAVVNAVKRAGLYAQTLPAQLSQLPACGE

SEQ ID NO: 1109 - protein, 427 aa, Escherichia coli
MDFQLYSLGAALVFHEIFFPESSTAMALILAMGTYGAGYVARIVGAFIFGKMGDRIGRKKVLFITITMMGICTTLIGVLPTYAQIGVFAPILLVTLRIIQGLGAGAEISGAGTMLAEYAPKGKRGIISSFVAMGTNCGTLSATAIWAFMFFILSKEELLAWGWRIPFLASVVVMVFAIWLRMNLKESPVFEKVNDSNQPTAKPAPAGSMFQSKSFWLATGLRFGQAGNSGLIQTFLAGYLVQTLLFNKAIPTDALMISSILGFMTIPFLGWLSDKIGRRIPYIIMNTSAIVLAWPMLSIIVDKSYAPSTIMVALIVIHNCAVLGLFALENITMAEMFGCKNRFTRMAISKEIGGLIASGFGPILAGIFCTMTESWYPIAIMIMAYSVIGLISALKMPEVKDRDLSALEDAAEDQPRVVRAAQPSRSL

SEQ ID NO: 1110 - protein, 500 aa, Escherichia coli
MPHTIKKMSLIGLILMIFTSVFGFANSPSAYYLMGYSAIPFYIFSALLFFIPFALMMAEMGAAYRKEEGGIYSWMNNSVGPRFAFIGTFMWFSSYIIWMVSTSAKVWVPFSTFLYGSDMTQHWRIAGLEPTQVVGLLAVAWMILVTVVASKGINKIARITAVGGIAVMCLNLVLLLVSITILLLNGGHFAQDINFLASPNPGYQSGLAMLSFVVFAIFAYGGIEAVGGLVDKTENPEKNFAKGIVFAAIVISIGYSLAIFLWGVSTNWQQVLSNGSVNLGNITYVLMKSLGMTLGNALHLSPEASLSLGVWFARITGLSMFLAYTGAFFTLCYSPLKAIIQGTPKALWPEPMTRLNAMGMPSIAMWMQCGLVTVFILLVSFGGGTASAFFNKLTLMANVSMTLPYLFLALAFPFFKARQDLDRPFVIFKTHLSAMIATVVVVLVVTFANVFTIIQPVVEAGDWDSTLWMIGGPVFFSLLAMAIYQNYCSRVAKNPQWAVE

SEQ ID NO: 1111 - protein, 331 aa, Escherichia coli
MIKRNLPLMITIGVFVLGYLYCLTQFPGFASTRVICNILTDNAFLGIIAVGMTFVILSGGIDLSVGSVIAFTGVFLAKVIGDFGLSPLLAFPLVLVMGCAFGAFMGLLIDALKIPAFIITLAGMFFLRGVSYLVSEESIPINHPIYDTLSSLAWKIPGGGRLSAMGLLMLAVVVIGIFLAHRTRFGNQVYAIGGNATSANLMGISTRSTTIRIYMLSTGLATLAGIVFSIYTQAGYALAGVGVELDAIASVVIGGTLLSGGVGTVLGTLFGVAIQGLIQTYINFDGTLSSWWTKIAIGILLFIFIALQRGLTVLWENRQSSPVTRVNIAQQ

SEQ ID NO: 1112 - protein, 452 aa, Escherichia coli
MEQYDQIGARLDRLPLARFHYRIFGIISFSLLLTGFLSYSGNVVLAKLVSNGWSNNFLNAAFTSALMFGYFIGSLTGGFIGDYFGRRRAFRINLLIVGIAATGAAFVPDMYWLIFFRFLMGTGMGALIMVGYASFTEFIPATVRGKWSARLSFVGNWSPMLSAAIGVVVIAFFSWRIMFLLGGIGILLAWFLSGKYFIESPRWLAGKGQIAGAECQLREVEQQIEREKSIRLPPLTSYQSNSKVKVIKGTFWLLFKGEMLRRTLVAITVLIAMNISLYTITVWIPTIFVNSGIDVDKSILMTAVIMIGAPVGIFIAALIIDHFPRRLFGSTLLIIIAVLGYIYSIQTTEWAILIYGLVMIFFLYMYVCFASAVYIPELWPTHLRLRGSGFVNAVGRIVAVFTPYGVAALLTHYGSITVFMVLGVMLLLCALVLSIFGIETRKVSLEEISEVN

SEQ ID NO: 1113 - protein, 529 aa, Escherichia coli
MTQTLLAIENLSVGFRHQQTVRTVVNDVSLQIEAGETLALVGESGSGKSVTALSILRLLPSPPVEYLSGDIRFHGESLLHASDQTLRGVRGNKIAMIFQEPMVSLNPLHTLEKQLYEVLSLHRGMRREAARGEILNCLDRVGIRQAAKRLTDYPHQLSGGERQRVMIAMALLTRPELLIADEPTTALDVSVQAQILQLLRELQGELNMGMLFITHNLSIVRKLAHRVAVMQNGRCVEQNYAATLFASPTHPYTQKLLNSEPSGDPVPLPEPASTLLDVEQLQVAFPIRKGILKRIVDHNVVVKNISFTLRAGETLGLVGESGSGKSTTGLALLRLINSQGSIIFDGQPLQNLNRRQLLPIRHRIQVVFQDPNSSLNPRLNVLQIIEEGLRVHQPTLSAAQREQQVIAVMHEVGLDPETRHRYPAEFSGGQRQRIAIARALILKPSLIILDEPTSSLDKTVQAQILTLLKSLQQKHQLAYLFISHDLHVVRALCHQVIILRQGEVVEQGPCARVFATPQQEYTRQLLALS

SEQ ID NO: 1114 - protein, 248 aa, Escherichia coli
MLSIKDLHVSVEDKAILRGLSLDVHPGEVHAIMGPNGSGKSTLSATLAGREDYEVTGGTVEFKGKDLLALSPEDRAGEGIFMAFQYPVEIPGVSNQFFLQTALNAVRSYRGQETLDRFDFQDLMEEKIALLKMPEDLLTRSVNVGFSGGEKKRNDILQMAVLEPELCILDESDSGLDIDALKVVADGVNSLRDGKRSFIIVTHYQRILDYIKPDYVHVLYQGRIVKSGDFTLVKQLEEQGYGWLTEQQ

SEQ ID NO: 1115 - protein, 458 aa, Escherichia coli
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 1116 - protein, 88 aa, Escherichia coli
MDINNKARIHWACRRGMRELDISIMPFFEHEYDSLSDDEKRIFIRLLECDDPDLFNWLMNHGKPADAELEMMVRLIQTRNRERGPVAI

SEQ ID NO: 1117 - protein, 255 aa, Escherichia coli
MNTARLNQGTPLLLNAVSKHYAENIVLNQLDLHIPAGQFVAVVGRSGGGKSTLLRLLAGLETPTAGDVLAGTTPLAEIQEDTRMMFQDARLLPWKSVIDNVGLGLKGQWRDAARRALAAVGLENRAGEWPAALSGGQKQRVALARALIHRPGLLLLDEPLGALDALTRLEMQDLIVSLWQEHGFTVLLVTHDVSEAVAMADRVLLIEEGKIGLDLTVDIPRPRRLGSVRLAELEAEVLQRVMQRGESETRLRKQG

SEQ ID NO: 1118 - protein, 392 aa, Escherichia coli
MIWIMTMARRMNGVYAAFMLVAFMMGVAGALQAPTLSLFLSREVGAQPFWIGLFYTVNAIAGIGVSLWLAKRSDSQGDRRKLIIFCCLMAIGNALLFAFNRHYLTLITCGVLLASLANTAMPQLFALAREYADNSAREVVMFSSVMRAQLSLAWVIGPPLAFMLALNYGFTVMFSIAAGIFTLSLVLIAFMLPSVARVELPSENALSMQGGWQDSNVRMLFVASTLMWTCNTMYIIDMPLWISSELGLPDKLAGFLMGTAAGLEIPAMILAGYYVKRYGKRRMMVIAVAAGVLFYTGLIFFNSRMALMTLQLFNAVFIGIVAGIGMLWFQDLMPGRAGAATTLFTNSISTGVILAGVIQGAIAQSWGHFAVYWVIAVISVVALFLTAKVKDV

SEQ ID NO: 1119 - protein, 901 aa, Escherichia coli
MLIKLLTKVFGSRNDRTLRRMRKVVNIINAMEPEMEKLSDEELKGKTAEFRARLEKGEVLENLIPEAFAVVREASKRVFGMRHFDVQLLGGMVLNERCIAEMRTGEGKTLTATLPAYLNALTGKGVHVVTVNDYLAQRDAENNRPLFEFLGLTVGINLPGMPAPAKREAYAADITYGTNNEYGFDYLRDNMAFSPEERVQRKLHYALVDEVDSILIDEARTPLIISGPAEDSSEMYKRVNKIIPHLIRQEKEDSETFQGEGHFSVDEKSRQVNLTERGLVLIEELLVKEGIMDEGESLYSPANIMLMHHVTAALRAHALFTRDVDYIVKDGEVIIVDEHTGRTMQGRRWSDGLHQAVEAKEGVQIQNENQTLASITFQNYFRLYEKLAGMTGTADTEAFEFSSIYKLDTVVVPTNRPMIRKDLPDLVYMTEAEKIQAIIEDIKERTAKGQPVLVGTISIEKSELVSNELTKAGIKHNVLNAKFHANEAAIVAQAGYPAAVTIATNMAGRGTDIVLGGSWQAEVAALENPTAEQIEKIKADWQVRHDAVLEAGGLHIIGTERHESRRIDNQLRGRSGRQGDAGSSRFYLSMEDALMRIFASDRVSGMMRKLGMKPGEAIEHPWVTKAIANAQRKVESRNFDIRKQLLEYDDVANDQRRAIYSQRNELLDVSDVSETINSIREDVFKATIDAYIPPQSLEEMWDIPGLQERLKNDFDLDLPIAEWLDKEPELHEETLRERILAQSIEVYQRKEEVVGAEMMRHFEKGVMLQTLDSLWKEHLAAMDYLRQGIHLRGYAQKDPKQEYKRESFSMFAAMLESLKYEVISTLSKVQVRMPEEVEELEQQRRMEAERLAQMQQLSHQDDDSAAAAALAAQTGERKVGRNDPCPCGSGKKYKQCHGRLQ

SEQ ID NO: 1120 - protein, 547 aa, Escherichia coli
MLRHILTAKNLLSNPIFKFPNCLPFLSTVCCICRQFVGENLCSFADSPSLFEMWFHFLQLRSALNISSALRQVVHGTRWHAKRKSYKVLFWREITPLAVPIFMENACVLLMGVLSTFLVSWLGKDAMAGVGLADSFNMVIMAFFAAIDLGTTVVVAFSLGKRDRRRARVATRQSLVIMTLFAVLLATLIHHFGEQIIDFVAGDATTEVKALALTYLELTVLSYPAAAITLIGSGALRGAGNTKIPLLINGSLNILNIIISGILIYGLFSWPGLGFVGAGLGLTISRYIGAVAILWVLAIGFNPALRISLKSYFKPLNFSIIWEVMGIGIPASVESVLFTSGRLLTQMFVAGMGTSVIAGNFIAFSIAALINLPGSALGSASTIITGRRLGVGQIAQAEIQLRHVFWLSTLGLTAIAWLTAPFAGVMASFYTQDPQVKHVVVILIWLNALFMPIWSASWVLPAGFKGARDARYAMWVSMLSMWGCRVVVGYVLGIMLGWGVVGVWMGMFADWAVRAVLFYWRMVTGRWLWKYPRPEPQKCEKKPVVSE

SEQ ID NO: 1121 - protein, 329 aa, Escherichia coli
MNKWGVGLTFLLAATSVMAKDIQLLNVSYDPTRELYEQYNKAFSAHWKQQTGDNVVIRQSHGGSGKQATSVINGIEADVVTLALAYDVDAIAERGRIDKEWIKRLPDNSAPYTSTIVFLVRKGNPKQIHDWNDLIKPGVSVITPNPKSSGGARWNYLAAWGYALHHNNNDQAKAQDFVRALYKNVEVLDSGARGSTNTFVERGIGDVLIAWENEALLAANELGKDKFEIVTPSESILAEPTVSVVDKVVEKKGTKEVAEAYLKYLYSPEGQEIAAKNYYRPRDAEVAKKYENAFPKLKLFTIDEEFGGWTKAQKEHFANGGTFDQISKR

SEQ ID NO: 1122 - protein, 443 aa, Escherichia coli
MSTSDSIVSSQTKQSSWRKSDTTWTLGLFGTAIGAGVLFFPIRAGFGGLIPILLMLVLAYPIAFYCHRALARLCLSGSNPSGNITETVEEHFGKTGGVVITFLYFFAICPLLWIYGVTITNTFMTFWENQLGFAPLNRGFVALFLLLLMAFVIWFGKDLMVKVMSYLVWPFIASLVLISLSLIPYWNSAVIDQVDLGSLSLTGHDGILITVWLGISIMVFSFNFSPIVSSFVVSKREEYEKDFGRDFTERKCSQIISRASMLMVAVVMFFAFSCLFTLSPANMAEAKAQNIPVLSYLANHFASMTGTKTTFAITLEYAASIIALVAIFKSFFGHYLGTLEGLNGLVLKFGYKGDKTKVSLGKLNTISMIFIMGSTWVVAYANPNILDLIEAMGAPIIASLLCLLPMYAIRKAPSLAKYRGRLDNVFVTVIGLLTILNIVYKLF

SEQ ID NO: 1123 - protein, 267 aa, Escherichia coli
MHEITLLQGLSLAALVFVLGIDFWLEALFLFRPIIVCTLTGAILGDIQTGLITGGLTELAFAGLTPAGGVQPPNPIMAGLMTTVIAWSTGVDAKTAIGLGLPFSLLMQYVILFFYSAFSLFMTKADKCAKEADTAAFSRLNWTTMLIVASAYAVIAFLCTYLAQGAMQALVKAMPAWLTHGFEVAGGILPAVGFGLLLRVMFKAQYIPYLIAGFLFVCYIQVSNLLPVAVLGAGFAVYEFFNAKSRQQAQPQPVASKNEEEDYSNGI

SEQ ID NO: 1124 - protein, 831 aa, Escherichia coli
MLTIQFLCPLPNGLHARPAWELKEQCSQWQSEITFINHRQNAKADAKSSLALIGTGTLFNDSCSLNISGSDEEQARRVLEEYIQVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIISNMEQVCAKLSASASDYLRERVSDIRDISEQLLHITWPELKPRNKLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIAANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQDFSNKEQAIQFLCGNLGVNGRTEHPFELEEDVWQREEIVTTGVGFGVAIPHTKSQWIRHSSISIARLAKPIGWQSEMGEVELVIMLTLGANEGMNHVKVFSQLARKLVNKNFRQSLFAAQDAQSILTLLETELTF

SEQ ID NO: 1125 - protein, 352 aa, Escherichia coli
MVFRIASSPYTHNQRQTSRIMLLVLLAAVPGIAAQLWFFGWGTLVQILLASVSALLAEALVLKLRKQSVAATLKDNSALLTGLLLAVSIPPLAPWWMVVLGTVFAVIIAKQLYGGLGQNPFNPAMIGYVVLLISFPVQMTSWLPPHEIAVNIPGFIDAIQVIFSGHTASGGDMNTLRLGIDGISQATPLDTFKTSVRAGHSVEQIMQYPIYSGILAGAGWQWVNLAWLAGGVWLLWQKAIRWHIPLSFLVTLALCAMLGWLFSPETLAAPQIHLLSGATMLGAFFILTDPVTASTTNRGRLIFGALAGLLVWLIRSFGGYPDGVAFAVLLANITVPLIDYYTRPRVYGHRKG

SEQ ID NO: 1126 - protein, 461 aa, Escherichia coli
MAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYDGDRTPVSET

SEQ ID NO: 1127 - protein, 748 aa, Escherichia coli
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARAKYLLRRIDYAEAENLAQRSLEAQLATEVRHQVAAFMERRGMGGLIRGGL

SEQ ID NO: 1128 - protein, 458 aa, Escherichia coli
MKIIILGAGQVGGTLAENLVGENNDITVVDTNGERLRTLQDKFDLRVVQGHGSHPRVLREAGADDADMLVAVTSSDETNMVACQVAYSLFNTPNRIARIRSPDYVRDADKLFHSDAVPIDHLIAPEQLVIDNIYRLIEYPGALQVVNFAEGKVSLAVVKAYYGGPLIGNALSTMREHMPHIDTRVAAIFRHDRPIRPQGSTIVEAGDEVFFIAASQHIRAVMSELQRLEKPYKRIMLVGGGNIGAGLARRLEKDYSVKLIERNQQRAAELAEKLQNTIVFFGDASDQELLAEEHIDQVDLFIAVTNDDEANIMSAMLAKRMGAKKVMVLIQRRAYVDLVQGSVIDIAISPQQATISALLSHVRKADIVGVSSLRRGVAEAIEAVAHGDESTSRVVGRVIDEIKLPPGTIIGAVVRGNDVMIANDNLRIEQGDHVIMFLTDKKFITDVERLFQPSPFFL

SEQ ID NO: 1129 - protein, 625 aa, Escherichia coli
MTELARKIVAGVGGADNIVSLMHCATRLRFKLKDESKAQAEVLKKTPGIIMVVESGGQFQVVIGNHVADVFLAVNSVAGLDEKAQQAPENDDKGNLLNRFVYVISGIFTPLIGLMAATGILKGMLALALTFQWTTEQSGTYLILFSASDALFWFFPIILGYTAGKRFGGNPFTAMVIGGALVHPLILTAFENGQKADALGLDFLGIPVTLLNYSSSVIPIIFSAWLCSILERRLNAWLPSAIKNFFTPLLCLMVITPVTFLLVGPLSTWISELIAAGYLWLYQAVPAFAGAVMGGFWQIFVMFGLHWGLVPLCINNFTVLGYDTMIPLLMPAIMAQVGAALGVFLCERDAQKKVVAGSAALTSLFGITEPAVYGVNLPRKYPFVIACISGALGATIIGYAQTKVYSFGLPSIFTFMQTIPSTGIDFTVWASVIGGVIAIGCAFVGTVMLHFITAKRQPAQGAPQEKTPEVITPPEQGGICSPMTGEIVPLIHVADTTFASGLLGKGIAILPSVGEVRSPVAGRIASLFATLHAIGIESDDGVEILIHVGIDTVKLDGKFFSAHVNVGDKVNTGDRLISFDIPAIREAGFDLTTPVLISNSDDFTDVLPHGTAQISAGEPLLSIIR

SEQ ID NO: 1130 - protein, 1120 aa, Escherichia coli
MTMFQYYKRSRHFVFSAFIAFVFVLLCQNTAFARASSNGDLPTKADLQAQLDSLNKQKDLSAQDKLVQQDLTDTLATLDKIDRIKEETVQLRQKVAEAPEKMRQATAALTALSDVDNDEETRKILSTLSLRQLETRVAQALDDLQNAQNDLASYNSQLVSLQTQPERVQNAMYNASQQLQQIRSRLDGTDVGETALRPSQKVLMQAQQALLNAEIDQQRKSLEGNTVLQDTLQKQRDYVTANSARLEHQLQLLQEAVNSKRLTLTEKTAQEAVSPDEAARIQANPLVKQELEINQQLSQRLITATENGNQLMQQNIKVKNWLERALQSERNIKEQIAVLKGSLLLSRILYQQQQTLPSADELENMTNRIADLRLEQFEVNQQRDALFQSDAFVNKLEEGHTNEVNSEVHDALLQVVDMRRELLDQLNKQLGNQLMMAINLQINQQQLMSVSKNLKSILTQQIFWVNSNRPMDWDWIKAFPQSLKDEFKSMKITVNWQKAWPAVFIAFLAGLPLLLIAGLIHWRLGWLKAYQQKLASAVGSLRNDSQLNTPKAILIDLIRALPVCLIILAVGLILLTMQLNISELLWSFSKKLAIFWLVFGLCWKVLEKNGVAVRHFGMPEQQTSHWRRQIVRISLALLPIHFWSVVAELSPLHLMDDVLGQAMIFFNLLLIAFLVWPMCRESWRDKESHTMRLVTITVLSIIPIALMVLTATGYFYTTLRLAGRWIETVYLVIIWNLLYQTVLRGLSVAARRIAWRRALARRQNLVKEGAEGAEPPEEPTIALEQVNQQTLRITMLLMFALFGVMFWAIWSDLITVFSYLDSITLWHYNGTEAGAAVVKNVTMGSLLFAIIASMVAWALIRNLPGLLEVLVLSRLNMRQGASYAITTILNYIIIAVGAMTVFGSLGVSWDKLQWLAAALSVGLGFGLQEIFGNFVSGLIILFERPVRIGDTVTIGSFSGTVSKIRIRATTITDFDRKEVIIPNKAFVTERLINWSLTDTTTRLVIRLGVAYGSDLEKVRKVLLKAATEHPRVMHEPMPEVFFTAFGASTLDHELRLYVRELRDRSRTVDELNRTIDQLCRENDINIAFNQLEVHLHNEKGDEVTEVKRDYKGDDPTPAVG

SEQ ID NO: 1131 - protein, 268 aa, Escherichia coli
MTLLNISGLSHHYAHGGFNGKHQHQAVLNNVSLTLKSGETVALLGRSGCGKSTLARLLVGLESPAQGNISWRGEPLAKLNRAQRKAFRRDIQMVFQDSISAVNPRKTVREILREPMRHLLSLKKSEQLARASEMLKAVDLDDSVLDKRPPQLSGGQLQRVCLARALAVEPKLLILDEAVSNLDLVLQAGVIRLLKKLQQQFGTACLFITHDLRLVERFCQRVMVMDNGQIVETQVVGEKLTFSSDAGRVLQNAVLPAFPVRRRTTEKV

SEQ ID NO: 1132 - protein, 588 aa, Escherichia coli
MKLPVREFDAVVIGAGGAGMRAALQISQSGQTCALLSKVFPTRSHTVSAQGGITVALGNTHEDNWEWHMYDTVKGSDYIGDQDAIEYMCKTGPEAILELEHMGLPFSRLDDGRIYQRPFGGQSKNFGGEQAARTAAAADRTGHALLHTLYQQNLKNHTTIFSEWYALDLVKNQDGAVVGCTALCIETGEVVYFKARATVLATGGAGRIYQSTTNAHINTGDGVGMAIRAGVPVQDMEMWQFHPTGIAGAGVLVTEGCRGEGGYLLNKHGERFMERYAPNAKDLAGRDVVARSIMIEIREGRGCDGPWGPHAKLKLDHLGKEVLESRLPGILELSRTFAHVDPVKEPIPVIPTCHYMMGGIPTKVTGQALTVNEKGEDVVVPGLFAVGEIACVSVHGANRLGGNSLLDLVVFGRAAGLHLQESIAEQGALRDASESDVEASLDRLNRWNNNRNGEDPVAIRKALQECMQHNFSVFREGDAMAKGLEQLKVIRERLKNARLDDTSSEFNTQRVECLELDNLMETAYATAVSANFRTESRGAHSRFDFPDRDDENWLCHSLYLPESESMTRRSVNMEPKLRPAFPPKIRTY

SEQ ID NO: 1133 - protein, 429 aa, Escherichia coli
METTQTSTIASKDSRSAWRKTDTMWMLGLYGTAIGAGVLFLPINAGVGGMIPLIIMAILAFPMTFFAHRGLTRFVLSGKNPGEDITEVVEEHFGIGAGKLITLLYFFAIYPILLVYSVAITNTVESFMSHQLGMTPPPRAILSLILIVGMMTIVRFGEQMIVKAMSILVFPFVGVLMLLALYLIPQWNGAALETLSLDTASATGNGLWMTLWLAIPVMVFSFNHSPIISSFAVAKREEYGDMAEQKCSKILAFAHIMMVLTVMFFVFSCVLSLTPADLAAAKEQNISILSYLANHFNAPVIAWMAPIIAIIAITKSFLGHYLGAREGFNGMVIKSLRGKGKSIEINKLNRITALFMLVTTWIVATLNPSILGMIETLGGPIIAMILFLMPMYAIQKVPAMRKYSGHISNVFVVVMGLIAISAIFYSLFS

SEQ ID NO: 1134 - protein, 344 aa, Escherichia coli
MAKPIITLNGLKIVIMLGMLVIILCGIRFAAEIIVPFILALFIAVILNPLVQHMVRWRVPRVLAVSILMTIIVMAMVLLLAYLGSALNELTRTLPQYRNSIMTPLQALEPLLQRVGIDVSVDQLAHYIDPNAAMTLLTNLLTQLSNAMSSIFLLLLTVLFMLLEVPQLPGKFQQMMARPVEGMAAIQRAIDSVSHYLVLKTAISIITGLVAWAMLAALDVRFAFVWGLLAFALNYIPNIGSVLAAIPPIAQVLVFNGFYEALLVLAGYLLINLVFGNILEPRIMGRGLGLSTLVVFLSLIFWGWLLGPVGMLLSVPLTIIVKIALEQTAGGQSIAVLLSDLNKE

SEQ ID NO: 1135 - protein, 337 aa, Escherichia coli
MSVIETATVPLAQQQADALLNVKDLRVTFSTPDGDVTAVNDLNFSLRAGETLGIVGESGSGKSQTAFALMGLLAANGRIGGSATFNGREILNLPEHELNKLRAEQISMIFQDPMTSLNPYMRVGEQLMEVLMLHKNMSKAEAFEESVRMLDAVKMPEARKRMKMYPHEFSGGMRQRVMIAMALLCRPKLLIADEPTTALDVTVQAQIMTLLNELKREFNTAIIMITHDLVVVAGICDKVLVMYAGRTMEYGNARDVFYQPVHPYSIGLLNAVPRLDAEGETMLTIPGNPPNLLRLPKGCPFQPRCPHAMEICSSAPPLEEFTPGRLRACFKPVEELL

SEQ ID NO: 1136 - protein, 293 aa, Escherichia coli
MPWIQLKLNTTGANAEDLSDALMEAGAVSITFQDTHDTPVFEPLPGETRLWGDTDVIGLFDAETDMNDVVAILENHPLLGAGFAHKIEQLEDKDWEREWMDNFHPMRFGERLWICPSWRDVPDENAVNVMLDPGLAFGTGTHPTTSLCLQWLDSLDLTGKTVIDFGCGSGILAIAALKLGAAKAIGIDIDPQAIQASRDNAERNGVSDRLELYLPKDQPEEMKADVVVANILAGPLRELAPLISVLPVSGGLLGLSGILASQAESVCEAYADSFALDPVVEKEEWCRITGRKN

SEQ ID NO: 1137 - protein, 429 aa, Escherichia coli
MSTALLDAVVKKNRVRLIPFMLALYVLAFLDRSNIGFAKQTYQIDTGLSNEAYALGAGIFFVVYAFLGVPANLLMRKLGARTWIGTTTLLWGFLSAAMAWADTEAKFLIVRTLLRAAEAGFFPGMIYLTSQWFPQRNRASIMGLFYMGAPLALTLGSPLSGALLEMHGFMGHPGWFWMFVIEGLLAVGAGVFTFFWLDDTPEQARFLSKQEKTLLINQLASEEQQKVTSRLSDALRNGRVWQLAIIYLTIQVAVYGLIFFLPTQVAALLGTKVGFTASVVTAIPWVAALFGTWLIPRYSDKTGERRNVAALTLLAAGIGIGLSGLLSPVMAIVALCVAAIGFIAVQPVFWTMPTQLLSGTALAAGIGFVNLFGAVGGFIAPILRVKAETLFASDAAGLLTLAAVAVIGSLIIFTLRVNRTVAQTDVAHH

SEQ ID NO: 1138 - protein, 867 aa, Escherichia coli
MKIPTTTDIPQRYTWCLAGICYSSLAILPSFLSYAESYFNPAFLLENGTSVADLSRFERGNHQPAGVYRVDLWRNDEFIGSQDIVFESTTENTGDKSGGLMPCFNQVLLERIGLNSSAFPELAQQQNNKCINLLKAVPDATINFDFAAMRLNITIPQIALLSSAHGYIPPEEWDEGIPALLLNYNFTGNRGNGNDSYFFSELSGINIGPWRLRNNGSWNYFRGNGYHSEQWNNIGTWVQRAIIPLKSELVMGDGNTGSDIFDGVGFRGVRLYSSDNMYPDSQQGFAPTVRGIARTAAQLTIRQNGFIIYQSYVSPGAFEITDLHPTSSNGDLDVTIDERDGNQQNYTIPYSTVPILQREGRFKFDLTAGDFRSGNSQQSSPFFFQGTALGGLPQEFTAYGGTQLSANYTAFLLGLGRNLGNWGAVSLDVTHARSQLADASRHEGDSIRFLYAKSMNTFGTNFQLMGYRYSTQGFYTLDDVAYRRMEGYEYDYDGEHRDEPIIVNYHNLRFSRKDRLQLNVSQSLNDFGSLYISGTHQKYWNTSDSDTWYQVGYTSSWVGISYSLSFSWNESVGIPDNERIVGLNVSVPFNVLTKRRYTRENALDRAYASFNANRNSNGQNSWLAGVGGTLLEGHNLSYHVSQGDTSNNGYTGSATANWQAAYGTLGGGYNYDRDQHDVNWQLSGGVVGHENGITLSQPLGDTNVLIKAPGAGGVRIENQTGILTDWRGYAVMLYATVYRYNRIALDTNTMGNSIDVEKNISSVVPTQGALVRANFDTRIGVRALITVTQGGKPVPFGSLVRENSTGITSMVGDDGQVYLSGAPLSGELLVQWGDGANSRCIAHYVLPKQSLQQAVTVISAVCTHPGS

SEQ ID NO: 1139 - protein, 1025 aa, Escherichia coli
MKFFALFIYRPVATILLSVAITLCGILGFRMLPVAPLPQVDFPVIIVSASLPGASPETMASSVATPLERSLGRIAGVSEMTSSSSLGSTRIILQFDFDRDINGAARDVQAAINAAQSLLPSGMPSRPTYRKANPSDAPIMILTLTSDTYSQGELYDFASTQLAPTISQIDGVGDVDVGGSSLPAVRVGLNPQALFNQGVSLDDVRTAVSNANVRKPQGALEDGTHRWQIQTNDELKTAAEYQPLIIHYNNGGAVRLGDVATVTDSVQDVRNAGMTNAKPAILLMIRKLPEANIIQTVDSIRAKLPELQETIPAAIDLQIAQDRSPTIRASLEEVEQTLIISVALVILVVFLFLRSGRATIIPAVSVPVSLIGTFAAMYLCGFSLNNLSLMALTIATGFVVDDAIVVLENIARHLEAGMKPLQAALQGTREVGFTVLSMSLSLVAVFLPLLLMGGLPGRLLREFAVTLSVAIGISLLVSLTLTPMMCGWMLKASKPREQKRLRGFGRMLVALQQGYGKSLKWVLNHTRLVGVVLLGTIALNIWLYISIPKTFFPEQDTGVLMGGIQADQSISFQAMRGKLQDFMKIIRDDPAVDNVTGFTGGSRVNSGMMFITLKPRDERSETAQQIIDRLRVKLAKEPGANLFLMAVQDIRVGGRQSNASYQYTLLSDDLAALREWEPKIRKKLATLPELADVNSDQQDNGAEMNLVYDRDTMARLGIDVQAANSLLNNAFGQRQISTIYQPMNQYKVVMEVDPRYTQDISALEKMFVINNEGKAIPLSYFAKWQPANAPLSVNHQGLSAASTISFNLPTGKSLSDASAAIDRAMTQLGVPSTVRGSFAGTAQVFQETMNSQVILIIAAIATVYIVLGILYESYVHPLTILSTLPSAGVGALLALELFNAPFSLIALIGIMLLIGIVKKNAIMMVDFALEAQRHGNLTPQEAIFQACLLRFRPIMMTTLAALFGALPLVLSGGDGSELRQPLGITIVGGLVMSQLLTLYTTPVVYLFFDRLRLRFSRKPKQTVTE

SEQ ID NO: 1140 - protein, 295 aa, Escherichia coli
MLILLGYLVVLGTVFGGYLMTGGSLGALYQPAELVIIAGAGIGSFIVGNNGKAIKGTLKALPLLFRRSKYTKAMYMDLLALLYRLMAKSRQMGMFSLERDIENPRESEIFASYPRILADSVMLDFIVDYLRLIISGHMNTFEIEALMDEEIETHESEAEVPANSLALVGDSLPAFGIVAAVMGVVHALGSADRPAAELGALIAHAMVGTFLGILLAYGFISPLATVLRQKSAETSKMMQCVKVTLLSNLNGYAPPIAVEFGRKTLYSSERPSFIELEEHVRAVKNPQQQTTTEEA

SEQ ID NO: 1141 - protein, 672 aa, Escherichia coli
MDALQLLTWSLILYLFASLASLFLLGLDRLAIKLSGITSLVGGVIGIISGITQLHAGVTLVARFAPPFEFADLTLRMDSLSAFMVLVISLLVVVCSLYSLTYMREYEGKGAAAMGFFMNIFIASMVALLVMDNAFWFIVLFEMMSLSSWFLVIARQDKTSINAGMLYFFIAHAGSVLIMIAFLLMGRESGSLDFASFRTLSLSPGLASAVFLLAFFGFGAKAGMMPLHSWLPRAHPAAPSHASALMSGVMVKIGIFGILKVAMDLLAQTGLPLWWGILVMAIGAISALLGVLYALAEQDIKRLLAWSTVENVGIILLAVGVAMVGLSLHDPLLTVVGLLGALFHLLNHALFKGLLFLGAGAIISRLHTHDMEKMGALAKRMPWTAAACLIGCLAISAIPPLNGFISEWYTWQSLFSLSRVEAVALQLAGPIAMVMLAVTGGLAVMCFVKMYGITFCGAPRSTHAEEAQEVPNTMIVAMLLLAALCVLIALSASWLAPKIMHIAHAFTNTPPATVASGIALVPGTFHTQVTPSLLLLLLLAMPLLPGLYWLWCRSRRAAFRRTGDAWACGYGWENAMAPSGNGVMQPLRVVFSALFRLRQQLDPTLRLNKGLAHVTARAQSTEPFWDERVIRPIVSATQRLAKEIQHLQSGDFRLYCLYVVAALVVLLIAIAV

SEQ ID NO: 1142 - protein, 360 aa, Escherichia coli
MQPFGVLDRYIGKTIFTTIMMTLFMLVSLSGIIKFVDQLKKAGQGSYDALGAGMYTLLSVPKDVQIFFPMAALLGALLGLGMLAQRSELVVMQASGFTRMQVALSVMKTAIPLVLLTMAIGEWVAPQGEQMARNYRAQAMYGGSLLSTQQGLWAKDGNNFVYIERVKGDEELGGISIYAFNENRRLQSVRYAATAKFDPEHKVWRLSQVDESDLTNPKQITGSQTVSGTWKTNLTPDKLGVVALDPDALSISGLHNYVKYLKSSGQDAGRYQLNMWSKIFQPLSVAVMMLMALSFIFGPLRSVPMGVRVVTGISFGFVFYVLDQIFGPLTLVYGIPPIIGALLPSASFFLISLWLLMRKS

SEQ ID NO: 1143 - protein, 377 aa, Escherichia coli
MNDAIPRPQAKTRKALTPLLEIRNLTKSYDGQHAVDDVSLTIYKGEIFALLGASGCGKSTLLRMLAGFEQPSAGQIMLDGVDLSQVPPYLRPINMMFQSYALFPHMTVEQNIAFGLKQDKLPKAEIASRVNEMLGLVHMQEFAKRKPHQLSGGQRQRVALARSLAKRPKLLLLDEPMGALDKKLRDRMQLEVVDILERVGVTCVMVTHDQEEAMTMAGRIAIMNRGKFVQIGEPEEIYEHPTTRYSAEFIGSVNVFEGVLKERQEDGLVLDSPGLVHPLKVDADASVVDNVPVHVALRPEKIMLCEEPPANGCNFAVGEVIHIAYLGDLSVYHVRLKSGQMISAQLQNAHRHRKGLPTWGDEVRLCWEVDSCVVLTV

SEQ ID NO: 1144 - protein, 301 aa, Escherichia coli
MKKLLPCTALVMCAGMACAQAEERNDWHFNIGAMYEIENVEGYGEDMDGLAEPSVYFNAANGPWRIALAYYQEGPVDYSAGKRGTWFDRPELEVHYQFLENDDFSFGLTGGFRNYGYHYVDEPGKDTANMQRWKIAPDWDVKLTDDLRFNGWLSMYKFANDLNTTGYADTRVETETGLQYTFNETVALRVNYYLERGFNMDDSRNNGEFSTQEIRAYLPLTLGNHSVTPYTRIGLDRWSNWDWQDDIEREGHDFNRVGLFYGYDFQNGLSVSLEYAFEWQDHDEGDSDKFHYAGVGVNYSF

SEQ ID NO: 1145 - protein, 446 aa, Escherichia coli
MTTLTLVLTAVGSVLLLLFLVMKARMHAFLALMVVSMGAGLFSGMPLDKIAATMEKGMGGTLGFLAVVVALGAMFGKILHETGAVDQIAVKMLKSFGHSRAHYAIGLAGLVCALPLFFEVAIVLLISVAFSMARHTGTNLVKLVIPLFAGVAAAAAFLVPGPAPMLLASQMNADFGWMILIGLCAAIPGMIIAGPLWGNFISRYVELHIPDDISEPHLGEGKMPSFGFSLSLILLPLVLVGLKTIAARFVPEGSTAYEWFEFIGHPFTAILVACLVAIYGLAMRQGMPKDKVMEICGHALQPAGIILLVIGAGGVFKQVLVDSGVGPALGEALTGMGLPIAITCFVLAAAVRIIQGSATVACLTAVGLVMPVIEQLNYSGAQMAALSICIAGGSIVVSHVNDAGFWLFGKFTGATEAETLKTWTMMETILGTVGAIVGMIAFQLLS

SEQ ID NO: 1146 - protein, 206 aa, Escherichia coli
MLMLFLTVAMVHIVALMSPGPDFFFVSQTAVSRSRKEAMMGVLGITCGVMVWAGIALLGLHLIIEKMAWLHTLIMVGGGLYLCWMGYQMLRGALKKEAVSAPAPQVELAKSGRSFLKGLLTNLANPKAIIYFGSVFSLFVGDNVGTTARWGIFALIIVETLAWFTVVASLFALPQMRRGYQRLAKWIDGFAGALFAGFGIHLIISR

SEQ ID NO: 1147 - protein, 404 aa, Escherichia coli
MKNPYFPTALGLYFNYLVHGMGVLLMSLNMASLETLWQTNAAGVSIVISSLGIGRLSVLLFAGLLSDRFGRRPFIMLGMCCYMAFFFGILQTNNIIIAYVFGFLAGMANSFLDAGTYPSLMEAFPRSPGTANILIKAFVSSGQFLLPLIISLLVWAELWFGWSFMIAAGIMFINALFLYRCTFPPHPGRRLPVIKKTTSSTEHRCSIIDLASYTLYGYISMATFYLVSQWLAQYGQFVAGMSYTMSIKLLSIYTVGSLLCVFITAPLIRNTVRPTTLLMLYTFISFIALFTVCLHPTFYVVIIFAFVIGFTSAGGVVQIGLTLMAERFPYAKGKATGIYYSAGSIATFTIPLITAHLSQRSIADIMWFDTAIAAIGFLLALFIGLRSRKKTRHHSLKENVAPGG

SEQ ID NO: 1148 - protein, 429 aa, Escherichia coli
MTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVLFPPAAMGAIVAVIGLELAGVAAGMAGLLPAEGQTPDSKTIIISITTLAVTVLGSVLFRGFLAIIPILIGVLVGYALSFAMGIVDTTPIINAHWFALPTLYTPRFEWFAILTILPAALVVIAEHVGHLVVTANIVKKDLLRDPGLHRSMFANGLSTVISGFFGSTPNTTYGENIGVMAITRVYSTWVIGGAAIFAILLSCVGKLAAAIQMIPLPVMGGVSLLLYGVIGASGIRVLIESKVDYNKAQNLILTSVILIIGVSGAKVNIGAAELKGMALATIVGIGLSLIFKLISVLRPEEVVLDAEDADITDK

SEQ ID NO: 1149 - protein, 410 aa, Escherichia coli
MPRFFTRHAATLFFPMALILYDFAAYLSTDLIQPGIINVVRDFNADVSLAPAAVSLYLAGGMALQWLLGPLSDRIGRRPVLITGALIFTLACAATMFTTSMTQFLIARAIQGTSICFIATVGYVTVQEAFGQTKGIKLMAIITSIVLIAPIIGPLSGAALMHFMHWKVLFAIIAVMGFISFVGLLLAMPETVKRGAVPFSAKSVLRDFRNVFCNRLFLFGAATISLSYIPMMSWVAVSPVILIDAGSLTTSQFAWTQVPVFGAVIVANAIVARFVKDPTEPRFIWRAVPIQLVGLSLLIVGNLLSPHVWLWSVLGTSLYAFGIGLIFPTLFRFTLFSNKLPKGTVSASLNMVILMVMSVSVEIGRWLWFNGGRLPFHLLAVVAGVIVVFTLAGLLNRVRQHQAAELVEEQ

SEQ ID NO: 1150 - protein, 120 aa, Escherichia coli
MLKLFAKYTSIGVLNTLIHWVVFGVCIYVAHTNQALANFAGFVVAVSFSFFANAKFTFKASTTTMRYMLYVGFMGTLSATVGWAADRCALPPMITLVTFSAISLVCGFVYSKFIVFRDAK

SEQ ID NO: 1151 - protein, 561 aa, Escherichia coli
MITIPITLRMLIAKYLCLLKPFWLRKNNKTSVLLIIIILAMILGVVKIQVWLNDWNNDFFNALSQKETDKLWQLVLWFPALLGIFVLISVNKTWLIKLLTIRWREWLTDYYLNRWFADKNYYFTQIYGEHKNTDNPDQRIAEDILLLISKTLSLSFGFIQSLSMLITFTVILWESAGTLSFTVGGTEWNIQGYMVYTVVLIVIGGTLFTHKVGKRIRPLNVEKQRSEATFRTNLVQHNKQAELIALSNAESLQRQELSDNFHTIKENWHRLMNRQRWLDYWQNIYSRSLSVLPYFLLLPQFISGQINLGGLMKSRQAFMLVSNNLSWFIYKYDELAELAAVIDRLYEFHQLTEQRPTNKPKNCQHAVQVADASIRTPDNKIILENLNFHVSPGKWLLLKGYSGAGKTTLLKTLSHCWPWFKGDISSPADSWYVSQTPLIKTGLLKEIICKALPLPVDDKSLSEVLHQVGLGKLAARIHDHDRWGDILSSGEKQRIALARLILRRPKWIFLDETTSHLEEQEAIRLLRLVREKLPTSGVIMVTHQPGVWNLADDICDISAVL

SEQ ID NO: 1152 - protein, 389 aa, Escherichia coli
MKINYPLLALAIGAFGIGTTEFSPMGLLPVIARGVDVSIPAAGMLISAYAVGVMVGAPLMTLLLSHRARRSALIFLMAIFTLGNVLSAIAPDYMTLMLSRILTSLNHGAFFGLGSVVAASVVPKHKQASAVATMFMGLTLANIGGVPAATWLGETIGWRMSFLATAGLGVISMVSLFFSLPKGGAGARPEVKKELAVLMRPQVLSALLTTVLGAGAMFTLYTYISPVLQSITHATPVFVTAMLVLIGVGFSIGNYLGGKLADRSVNGTLKGFLLLLMVIMLAIPFLARNEFGAAISMVVWGAATFAVVPPLQMRVMRVASEAPGLSSSVNIGAFNLGNALGAAAGGAVISAGLGYSFVPVMGAIVAGLALLLVFMSARKQPETVCVANS

SEQ ID NO: 1153 - protein, 826 aa, Escherichia coli
MLRMTPLASAIVALLLGIEAYAAEETFDTHFMIGGMKDQQVANIRLDDNQPLPGQYDIDIYVNKQWRGKYEIIVKDNPQETCLSREVIKRLGINSDNFASGKQCLTFEQLVQGGSYTWDIGVFRLDFSVPQAWVEELESGYVPPENWERGINAFYTSYYLSQYYSDYKASGNNKSTYVRFNSGLNLLGWQLHSDASFSKTNNNPGVWKSNTLYLERGFAQLLGTLRVGDMYTSSDIFDSVRFRGVRLFRDMQMLPNSKQNFTPRVQGIAQSNALVTIEQNGFVVYQKEVPPGPFAITDLQLAGGGADLDVSVKEADGSVTTYLVPYAAVPNMLQPGVSKYDLAAGRSHIEGASKQSDFVQAGYQYGFNNLLTLYGGSMVANNYYAFTLGAGWNTRIGAISVDATKSHSKQDNGDVFDGQSYQIAYNKFVSQTSTRFGLAAWRYSSRDYRTFNDHVWANNKDNYRRDENDVYDIADYYQNDFGRKNSFSANMSQSLPEGWGSVSLSTLWRDYWGRSGSSKDYQLSYSNNLRRISYTLAASQAYDENHHEEKRFNIFISIPFDWGDDVSTPRRQIYMSNSTTFDDQGFASNNTGLSGTVGSRDQFNYGVNLSHQHQGNETTAGANLTWNAPVATVNGSYSQSSTYRQAGASVSGGIVAWSGGVNLANRLSETFAVMNAPGIKDAYVNGQKYRTTNRNGVVIYDGMTPYRENHLMLDVSQSDSEAELRGNRKIAAPYRGAVVLVNFDTDQRKPWFIKALRADGQSLTFGYEVNDIHGHNIGVVGQGSQLFIRTNEVPPSVNVAIDKQQGLSCTITFGKEIDESRNYICQ

SEQ ID NO: 1154 - protein, 459 aa, Escherichia coli
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMGVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLIAMNVVQYTLINWLPTIFMTQGINLKDSIVLNTMSMFGAPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSIIVAIAIATIGIETKGVSVESLSIDAVANK

SEQ ID NO: 1155 - protein, 256 aa, Escherichia coli
MQTEQQRAVTRLCIQCGLFLLQHGAESALVDELSSRLGRALGMDSVESSISSNAIVLTTIKDGQCLTSTRKNHDRGINMHVVTEVQHIVILAEHHLLDYKGVEKRFSQIQPLRYPRWLVALMVGLSCACFCKLNNGGWDGAVITFFASTTAMYIRQLLAQRHLHPQINFCLTAFAATTISGLLLQLPTFSNTPTIAMAASVLLLVPGFPLINAVADMFKGHINTGLARWAIASLLTLATCVGVVMALTIWGLRGWV

SEQ ID NO: 1156 - protein, 381 aa, Escherichia coli [sequence omitted]

SEQ ID NO: 1157 - protein, 176 aa, Escherichia coli [sequence omitted]

SEQ ID NO: 1158 - protein, 421 aa, Escherichia coli
MSKATEQNDKLKRAIIISAVLHVILFAALIWSSFDENIEASAGGGGGSSIDAVMVDSGAVVEQYKRMQSQESSAKRSDEQRKMKEQQAAEELREKQAAEQERLKQLEKERLAAQEQKKQAEEAAKQAELKQKQAEEAAAKAAADAKAKAEADAKAAEEAAKKAAADAKKKAEAEAAKAAAEAQKKAEAAAAALKKKAEAAEAAAAEARKKAATEAAEKAKAEAEKKAAAEKAAADKKAAAEKAAADKKAAEKAAAEKAAADKKAAAEKAAADKKAAAAKAAAEKAAAAKAAAEADDIFGELSSGKNAPKTGGGAKGNNASPAGSGNTKNNGASGADINNYAGQIKSAIESKFYDASSYAGKTCTLRIKLAPDGMLLDIKPEGGDPALCQAALAAAKLAKIPKPPSQAVYEVFKNAPLDFKP

SEQ ID NO: 1159 - protein, 110 aa, Escherichia coli
MYEALLVVFLIVAIGLVGLIMLQQGKGADMGASFGAGASATLFGSSGSGNFMTRMTALLATLFFIISLVLGNINSNKTNKGSEWENLSAPAKTEQTQPAAPAKPTSDIPN

SEQ ID NO: 1160 - protein, 263 aa, Escherichia coli
MATPVKKWLLRVAPWFLPVGIVAVWQLASSVGWLSTRILPSPEGVVTAFWTLSASGELWQHLAISSWRALIGFSIGGSLGLILGLISGLSRWGERLLDTSIQMLRNVPHLALIPLVILWFGIDESAKIFLVALGTLFPIYINTWHGIRNIDRGLVEMARSYGLSGIPLFIHVILPGALPSIMVGVRFALGLMWLTLIVAETISANSGIGYLAMNAREFLQTDVVVVAIILYALLGKLADVSAQLLERLWLRWNPAYHLKEATV

SEQ ID NO: 1161 - protein, 392 aa, Escherichia coli [sequence omitted]

SEQ ID NO: 1162 - protein, 319 aa, Escherichia coli
MRNIIKLALAGLLSVSTFAVAAESSPEALRIGYQKGSIGMVLAKSHQLLEKRYPESKISWVEFPAGPQMLEALNVGSIDLGSTGDIPPIFAQAAGADLVYVGVEPPKPKAEVILVAENSPIKTVADLKGHKVAFQKGSSSHNLLLRALRQAGLKFTDIQPTYLTPADARAAFQQGNVDAWAIWDPYYSAALLQGGVRVLKDGTDLNQTGSFYLAARPYAEKNGAFIQGVLATFSEADALTRSQREQSIALLAKTMGLPAPVIASYLDHRPPTTIKPVNAEVAALQQQTADLFYENRLVPKKVDIRQRIWQPTQLEGKQL

SEQ ID NO: 1163 - protein, 263 aa, Escherichia coli
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDDDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 1164 - protein, 414 aa, Escherichia coli
MTTQRSPGLFRRLAHGSLVKQILVGLVLGILLAWISKPAAEAVGLLGTLFVGALKAVAPILVLMLVMASIANHQHGQKTNIRPILFLYLLGTFSAALAAVVFSFAFPSTLHLSSSAGDISPPSGIVEVMRGLVMSMVSNPIDALLKGNYIGILVWAIGLGFALRHGNETTKNLVNDMSNAVTFMVKLVIRFAPIGIFGLVSSTLATTGFSTLWGYAQLLVVLVGCMLLVALVVNPLLVWWKIRRNPFPLVLLCLRESGVYAFFTRSSAANIPVNMALCEKLNLDRDTYSVSIPLGATINMAGAAITITVLTLAAVNTLGIPVDLPTALLLSVVASLCACGASGVAGGSLLLIPLACNMFGISNDIAMQVVAVGFIIGVLQDSCETALNSSTDVLFTAAACQAEDDRLANSALRN

SEQ ID NO: 1165 - protein, 425 aa, Escherichia coli
MKTTAKLSFMMFVEWFIWGAWFVPLWLWLSKSGFSAGEIGWSYACTAIAAILSPILVGSITDRFFSAQKVLAVLMFAGALLMYFAAQQTTFAGFFPLLLAYSLTYMPTIALTNSIAFANVPDVERDFPRIRVMGTIGWIASGLACGFLPQILGYADISPTNIPLLITAGSSALLGVFAFFLPDTPPKSTGKMDIKVMLGLDALILLRDKNFLVFFFCSFLFAMPLAFYYIFANGYLTEVGMKNATGWMTLGQFSEIFFMLALPFFTKRFGIKKVLLLGLVTAAIRYGFFIYGSADEYFTYALLFLGILLHGVSYDFYYVTAYIYVDKKAPVHMRTAAQGLITLCCQGFGSLLGYRLGGVMMEKMFAYQEPVNGLTFNWSGMWTFGAVMIAIIAVLFMIFFRESDNEITAIKVDDRDIALTQGEVK

SEQ ID NO: 1166 - protein, 881 aa, Escherichia coli
MPDHSLFRLRILPWCIALAMSGSYSSVWAEDDIQFDSRFLELKGDTKIDLKRFSSQGYVEPGKYNLQVQLNKQPLAEEYDIYWYAGEDDVSKSYACLTPELVAQFGLKEDVAKNLQWSHDGKCLKPGQLEGVEIKADLSQSALVISLPQAYLEYTWPDWDPPSRWDDGISGIIADYSITAQTRHEENGGDDSNEISGNGTVGVNLGPWRMRADWQTNYQHTRSNDDDDEFGGDDTQKKWEWSRYYAWRALPSLKAKLALGEDYLNSDIFDGFNYVGGSVSTDDQMLPPNLRGYAPDISGVAHTTAKVTVSQMGRVIYETQVPAGPFRIQDLGDSVSGTLHIRIEEQNGQVQEYDISTASMPYLTRPGQVRYKIMMGRPQEWGHHVEGGFFSGAEASWGIANGWSLYGGALGDENYQSAALGVGRDLSTFGAVAFDVTHSHTKLDKDTAYGKGSLDGNSFRVSYSKDFDQLNSRVTFAGYRFSEENFMTMSEYLDASDSEMVRTGNDKEMYTATYNQNFRDAGVSVYLNYTRHTYWDREEQTNYNIMLSHYFNMGSIRNMSVSLTGYRYEYDNRADKGMYISLSMPWGDNSTVSYNGNYGSGTDSSQVGYFSRVDDATHYQLNIGTSDKHTSVDGYYSHDGSLAQVDLSANYHEGQYTSAGLSLQGGATLTTHGGALHRTQNMGGTRLLIDADGVADVPVEGNGAAVYTNMFGKAVVSDVNNYYRNQAYIDLNKLPENAEATQSVVQATLTEGAIGYRKFAVISGQKAMAVLRLQDGSHPPFGAEVKNDNEQTVGLVDDDGSVYLAGVKPGEHMSVFWSGVAHCDINLPDPLPADLFNGLLLPCQHKGNVAPVVPDDIKPVIQEQTQQVTPTDPPVSVSANQ

SEQ ID NO: 1167 - protein, 421 aa, Escherichia coli
MSQNKAFSTPFILAVLCIYFSYFLHGISVITLAQNMSSLAEKFSTDNAGIAYLISGIGLGRLISILFFGVISDKFGRRAVILMAVIMYLLFFFGIPACPNLTLAYGLAVCVGIANSALDTGGYPALMECFPKASGSAVILVKAMVSFGQMFYPMLVSYMLLNNIWYGYGLIIPGILFVLITLMLLKSKFPSQLVDASVTNELPQMNSKPLVWLEGVSSVLFGVAAFSTFYVIVVWMPKYAMAFAGMSEAEALKTISYYSMGSLVCVFIFAALLKKMVRPIWANVFNSALATITAAIIYLYPSPLVCNAGAFVIGFSAAGGILQLGVSVMSEFFPKSKAKVTSIYMMMGGLANFVIPLITGYLSNIGLQYIIVLDFTFALLALITAIIVFIRYYRVFIIPENDVRFGERKFCTRLNTIKHRG

SEQ ID NO: 1168 - protein, 269 aa, Escherichia coli
METFNSLFMVSPLLLGVLFFVAMLAGFIDSIAGGGGLLTIPALMAAGMSPANALATNKLQACGGSISATIYFIRRKVVSLSDQKLNIAMTFVGSMSGALLVQYVQADVLRQILPILVICIGLYFLLMPKLGEEDRQRRMYGLPFALIAGGCVGFYDGFFGPAAGSFYALAFVTLCGFNLAKATAHAKLLNATSNIGGLLLFILGGKVIWATGFVMLVGQFLGARMGSRLVLSKGQKLIRPMIVIVSAVMSAKLLYDSHGQEILHWLGMN

SEQ ID NO: 1169 - protein, 195 aa, Escherichia coli
MTPTLLSAFWTYTLITAMTPGPNNILALSSATSHGFRQSTRVLAGMSLGFLIVMLLCAGISFSLAVIDPAAVHLLSWAGAAYIVWLAWKIATSPTKEDGLQAKPISFWASFALQFVNVKIILYGVTALSTFVLPQTQALSWVVGVSVLLAMIGTFGNVCWALAGHLFQRLFRQYGRQLNIVLALLLVYCAVRIFY

SEQ ID NO: 1170 - protein, 346 aa, Escherichia coli
MKKTAIAIAVALAGFATVAQAAPKDNTWYTGAKLGWSQYHDTGFINNNGPTHENQLGAGAFGGYQVNPYVGFEMGYDWLGRMPYKGSVENGAYKAQGVQLTAKLGYPITDDLDIYTRLGGMVWRADTKSNVYGKNHDTGVSPVFAGGVEYAITPEIATRLEYQWTNNIGDAHTIGTRPDNGMLSLGVSYRFGQGEAAPVVAPAPAPAPEVQTKHFTLKSDVLFNFNKATLKPEGQAALDQLYSQLSNLDPKDGSVVVLGYTDRIGSDAYNQGLSERRAQSVVDYLISKGIPADKISARGMGESNPVTGNTCDNVKQRAALIDCLAPDRRVEIEVKGIKDVVTQPQA

SEQ ID NO: 1171 - protein, 403 aa, Escherichia coli
MQPGKRFLVWLAGLSVLGFLATDMYLPAFAAIQADLQTPASAVSASLSLFLAGFAAAQLLWGPLSDRYGRKPVLLIGLTIFALGSLGMLWVENAATLLVLRFVQAVGVCAAAVIWQALVTDYYPSQKVNRIFAAIMPLVGLSPALAPLLGSWLLVHFSWQAIFATLFAITVVLILPIFWLKPTTKARNNSQDGLTFTDLLRSKTYRGNVLIYAACSASFFAWLTGSPFILSEMGYSPAVIGLSYVPQTIAFLIGGYGCRAALQKWQGKQLLPWLLVLFAVSVIATWAAGFISHVSLVEILIPFCVMAIANGAIYPIVVAQALRPFPHATGRAAALQNTLQLGLCFLASLVVSWLISISTPLLTTTSVMLSTVVLVALGYMMQRCEEVGCQNHGNAEVAHSESH

SEQ ID NO: 1172 - protein, 157 aa, Escherichia coli
MGVIEFLLALAQDMILAAIPAVGFAMVFNVPVRALRWCALLGSIGHGSRMILMTSGLNIEWSTFMASMLVGTIGIQWSRWYLAHPKVFTVAAVIPMFPGISAYTAMISAVKISQLGYSEPLMITLLTNFLTASSIVGALSIGLSIPGLWLYRKRPRV

SEQ ID NO: 1173 - protein, 225 aa, Escherichia coli
MQFLNMFFFDIYPYIAGAVFLIGSWLRYDYGQYTWRAASSQMLDRKGMNLASNLFHIGILGIFVGHFFGMLTPHWMYEAWLPIEVKQKMAMFAGGASGVLCLIGGVLLLKRRLFSPRVRATTTGADILILSLLVIQCALGLLTIPFSAQHMDGSEMMKLVGWAQSVVTFHGGASQHLDGVAFIFRLHLVLGMTLFLLFPFSRLIHIWSVPVEYLTRKYQLVRARH

SEQ ID NO: 1174 - protein, 807 aa, Escherichia coli
MYSSSRKRCPKTKWALKLLTAAFLAASPAAKSAVNNAYDALIIEARKGNTQPALSWFALKSALSNNQIADWLQIALWAGQDKQVITVYNRYRHQQLPARGYAAVAVAYRNLQQWQNSLTLWQKALSLEPQNKDYQRGQILTLADAGHYDTALVKLKQLNSGAPDKANLLAEAYIYKLAGRHQDELRAMTESLPENASTQQYPTEYVQALRNNQLAAAIDDANLTPDIRADIHAELVRLSFMPTRSESERYAIADRALAQYAALEILWHDNPDRTAQYQRIQVDHLGALLTRDRYKDVISHYQRLKKTGQIIPPWGQYWVASAYLKDHQPKKAQSIMTELFYHKETIAPDLSDEELADLFYSHLESENYPGALTVTQHTINTSPPFLRLMGTPTSIPNDTWLQGHSFLSTVAKYSNDLPQAEMTARELAYNAPGNQGLRIDYASVLQARGWPRAAENELKKAEVIEPRNINLEVEQAWTALTLQEWQQAAVLTHDVVEREPQDPGVVRLKRAVDVHNLAELRIAGSTGIDAEGPDSGKHDVDLTTIVYSPPLKDNWRGFAGFGYADGQFSEGKGIVRDWLAGVEWRSRNIWLEAEYAERVFNHEHKPGARLSGWYDFNDNWRIGSQLERLSHRVPLRAMKNGVTGNSAQAYVRWYQNERRKYGVSWAFTDFSDSNQRHEVSLEGQERIWSSPYLIVDFLPSLYYEQNTEHDTPYYNPIKTFDIVPAFEASHLLWRSYENSWEQIFSAGVGASWQKHYGTDVVTQLGYGQRISWNDVIDAGATLRWEKRPYDGDREHNLYVEFDMTFRF

SEQ ID NO: 1175 - protein, 499 aa, Escherichia coli
MLNLFVGLDIYTGLLLLLALAFVLFYEAINGFHDTANAVAAVIYTRAMQPQLAVVMAAFFNFFGVLLGGLSVAYAIVHMLPTDLLLNMGSTHGLAMVFSMLLAAIIWNLGTWFFGLPASSSHTLIGAIIGIGLTNALLTGSSVMDALNLREVTKIFSSLIVSPIVGLVIAGGLIFLLRRYWSGTKKRDRIHRIPEDRKKKKGKRKPPFWTRIALIVSAAGVAFSHGANDGQKGIGLVMLVLVGIAPAGFVVNMNASGYEITRTRDAVTNFEHYLQQHPELPQKLIAMEPPLPAASTDGTQVTEFHCHPANTFDAIARVKTMLPGNMESYEPLSVSQRSQLRRIMLCISDTSAKLAKLPGVSKEDQNLLKKLRSDMLSTIEYAPVWIIMAVALALGIGTMIGWRRVAMTIGEKIGKRGMTYAQGMAAQMTAAVSIGLASYIGMPVSTTHVLSSAVAGTMVVDGGGLQRKTVTSILMAWVFTLPAAIFLSGGLYWIALQLI

SEQ ID NO: 1176 - protein, 467 aa, Escherichia coli
MSDHNPLTLKLNLREKIAYGMGDVGSNLMLCIGTLYLLKFYTDELGMPAYYGGIIFLVAKFFTAFTDMLTGFLLDSRKNIGPKGKFRPFILYAAVPAALIATLQFIATTFCLPVKTTIATALFMMFGLSYSLMNCSYGAMIPAITKNPNERAQLAAYRQGGATIGLLICTVAFIPLQSLFSDSTVGYACAALMFSIGGFIFMMLCYRGVKEHYVDTTPTGHKASILKSFCAIFRNPPLLVLCIANLCTLAAFNIKLAIQVYYTQYVLNDINLLSWMGFFSMGCILIGVLLVPLTVKCFGKKQVYLAGMVLWAVGDILNYFWGSNSFTFVMFSCVAFFGTAFVNSLNWALVPDTVDYGEWKTGIRAEGSVYTGYTFFRKISAALAGFLPGIMLTQIGYVPNIAQSDATLQGLRQLIFIWPCALAIIAALTMGFFYTLNEKRFALIIEEINQRKNKEMATEEKTASVTL

SEQ ID NO: 1177 - protein, 549 aa, Escherichia coli
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTNIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSVQEENLERRFRLAALRSERAELYHLRATREISNETLQKLLHDLDLLEALLIEENQ

SEQ ID NO: 1178 - protein, 332 aa, Escherichia coli
MKLFRILDPFTLTLITVVLLASFFPARGDFVPFFENLTTAAIALLFFMHGAKLSREAIIAGGGHWRLHLWVMCSTFVLFPILGVLFAWWKPVNVDPMLYSGFLYLCILPATVQSAIAFTSMAGGNVAAAVCSASASSLLGIFLSPLLVGLVMNVHGAGGSLEQVGKIMLQLLLPFVLGHLSRPWIGDWVSRNKKWIAKTDQTSILLVVYTAFSEAVVNGIWHKVGWGSLLFIVVVSCVLLAIVIVVNVFMARRLSFNKADEITIVFCGSKKSLANGIPMANILFPTSVIGMMVLPLMIFHQIQLMVCAVLARRYKRQTEQLQAQQESSADKA

SEQ ID NO: 1179 - protein, 155 aa, Escherichia coli
MSEQNNTEMTFQIQRIYTKDISFEAPNAPHVFQKDWQPEVKLDLDTASSQLADDVYEVVLRVTVTASLGEETAFLCEVQQGGIFSIAGIEGTQMAHCLGAYCPNILFPYARECITSMVSRGTFPQLNLAPVNFDALFMNYLQQQAGEGTEEHQDA

SEQ ID NO: 1180 - protein, 393 aa, Escherichia coli
MHNSPAVSSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMRKELPLATGTIEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 1181 - protein, 395 aa, Escherichia coli
MNLSLRRSTSALLASSLLLTIGRGATLPFMTIYLSRQYSLSVDLIGYAMTIALTIGVVFSLGFGILADKFDKKRYMLLAITAFASGFIAITLVNNVTLVVLFFALINCAYSVFATVLKAWFADNLSSTSKTKIFSINYTMLNIGWTIGPPLGTLLVMQSINLPFWLAAICSAFPMLFIQIWVKRSEKIIATETGSVWSPKVLLQDKALLWFTCSGFLASFVSGAFASCISQYVMVIADGDFAEKVVAVVLPVNAAMVVTLQYSVGRRLNPANIRALMTAGTLCFVIGLVGFIFSGNSLLLWGMSAAVFTVGEIIYAPGEYMLIDHIAPPEMKASYFSAQSLGWLGAAINPLVSGVVLTSLPPSSLFVILALVIIAAWVLMLKGIRARPWGQPALC

SEQ ID NO: 1182 - protein, 205 aa, Escherichia coli
MTTQYGFFIDSSRCTGCKTCELACKDFKDLGPEVSFRRIYEYAGGDWQEDNGVWHQNVFAYYLSISCNHCDDPACTKVCPSGAMHKREDGFVVVDEDVCIGCRYCHMACPYGAPQYNAEKGHMTKCDGCYSRVAEGKQPICVESCPLRALEFGPIEELRQKHGTLAAVAPLPRAHFTKPNIVIKPNANSRPTGDTTGYLANPEEV

SEQ ID NO: 1183 - protein, 418 aa, Escherichia coli
MLHPRARTMLLLSLPAVAIGIASSLILIVVMKIASVLQNLLWQRLPGTLGIAQDSPLWIIGVLTLTGIAVGLVIRFSQGHAGPDPACEPLIGAPVPPSALPGLIVALILGLAGGVSLGPEHPIMTVNIALAVAIGARLLPRVNRMEWTILASAGTIGALFGTPVAAALIFSQTLNGSSEVPLWDRLFAPLMAAAAGALTTGLFFHPHFSLPIAHYGQMEMTDILSGAIVAAIAIAAGMVAVWCLPRLHAMMHQMKNPVLVLGIGGFILGILGVIGGPVSLFKGLDEMQQMVANQAFSTSDYFLLAVIKLAALVVAAASGFRGGRIFPAVFVGVALGLMLHEHVPAVPAAITVSCAILGIVLVVTRDGWLSLFMAAVVVPNTTLLPLLCIVMLPAWLLLAGKPMMMVNRPKQQPPHDNV

SEQ ID NO: 1184 - protein, 257 aa, Escherichia coli
MSVPLILTILAGAATFIGAFLGVLGQKPSNRLLAFSLGFAAGIMLLISLMEMLPAALAAEGMSPVLGYGMFIFGLLGYFGLDRMLPHAHPQDLMQKSVQPLPKSIKRTAILLTLGISLHNFPEGIATFVTASSNLELGFGIALAVALHNIPEGLAVAGPVYAATGSKRTAILWAGISGLAEILGGVLAWLILGSMISPVVMAAIMAAVAGIMVALSVDELMPLAKEIDPNNNPSYGVLCGMSVMGFSLVLLQTAGIG

SEQ ID NO: 1185 - protein, 223 aa, Escherichia coli
MTWSRRQFLTGVGVLAAVSGTAGRVVAKTLNINGVRYGMVHDESLCIGCTACMDACREVNKVPEGVSRLTIIRSEPQGEFPDVKYRFFRKSCQHCDHAPCVDVCPTGASFRDAASGIVDVNPDLCVGCQYCIAACPYRVRFIHPVTKTADKCDFCRKTNLQAGKLPACVEACPTKALTFGNLDDPNSEISQLLRQKPTYRYKLALGTKPKLYRVPFKYGEVSQ

SEQ ID NO: 1186 - protein, 415 aa, Escherichia coli
MNTNKLSLRRNVIYLAVVQGSNYLLPLLTFPYLVRTLGPENFGIFGFCQATMLYMIMFVEYGFNLTATQSIAKAADSKDKVTSIFWAVIFSKIVLIVITLIFLTSMTLLVPEYNKHAVIIWSFVPALVGNLIYPIWLFQGKEKMKWLTLSSILSRLAIIPLTFIFVNTKSDIAIAGFIQSSANLVAGIIALAIVVHEGWIGKVTLSLHNVRRSLADGFHVFISTSAISLYSTGIVIILGFISGPTSVGNFNAANTIRNALQGLLNPITQAIYPRISSTLVLNRVKGVILIKKSLTCLSLIGGAFSLILLLGASILVKISIGPGYDNAVIVLMIISPLPFLISLSNVYGIQVMLTHNYKKEFSKILIAAGLLSLLLIFPLTTLFKEIGAAITLLATECLVTSLMLMFVRNNKLLVC

SEQ ID NO: 1187 - protein, 274 aa, Escherichia coli
MTEFTTLLQQGNAWFFIPSAILLGALHGLEPGHSKTMMAAFIIAIKGTIKQAVMLGLAATISHTAVVWLIAFGGMVISKRFTAQSAEPWLQLISAVIIISTAFWMFWRTWRGERNWLENMHGHDYEHHHHDHEHHHDHGHHHHHEHGEYQDAHARAHANDIKRRFDGREVTNWQILLFGLTGGLIPCPAAITVLLICIQLKALTLGATLVVSFSIGLALTLVTVGVGAAISVQQVAKRWSGFNTLAKRAPYFSSLLIGLVGVYMGVHGFMGIMR

SEQ ID NO: 1188 - protein, 147 aa, Escherichia coli
MRLSDYFPESSISVIHSAKDWQEAIDFSMVSLLDKNYISENYIQAIKDSTINNGPYYILAPGVAMPHARPECGALKTGMSLTLLEQGVYFPGNDEPIKLLIGLSAADADSHIGAIQALSELLCEEEILEQLLTASSEKQLADIISRG

SEQ ID NO: 1189 - protein, 330 aa, Escherichia coli
MSQNTLKVHDLNEDAEFDENGVEVFDEKALVEQEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 1190 - protein, 187 aa, Escherichia coli [sequence omitted]

SEQ ID NO: 1191 - protein, 376 aa, Escherichia coli
MFQLSVQDIHPGEKAGDKEEAIRQVAAALVQAGNVAEGYVNGMLAREQQTSTFLGNGIAIPHGTTDTRDQVLKTGVQVFQFPEGVTWGDGQVAYVAIGIAASSDEHLGLLRQLTHVLSDDSVAEQLKSATTAEELRALLMGEKQSEQLKLDNEMLTLDIVASDLLTLQALNAARLKEAGAVDATFVTKAINEQPLNLGQGIWLSDSAEGNLRSAIAVSRAANAFDVDGETAAMLVSVAMNDDQPIAVLKRLADLLLDNKADRLLKADAATLLALLTSDDAPTDDVLSAEFVVRNEHGLHARPGTMLVNTIKQFNSDITVTNLDGTGKPANGRSLMKVVALGVKKGHRLRFTAQGADAEQALKAIGDAIAAGLGEGA

SEQ ID NO: 1192 - protein, 232 aa, Escherichia coli
MLKLTDITWLYHHLPMRFSLTVERGEQVAILGPSGAGKSTLLNLIAGFLTPASGSLTIDGVDHTTMPPSRRPVSMLFQENNLFSHLTVAQNIGLGLNPGLKLNAVQQGKMHAIARQMGIDNLMARLPGELSGGQRQRVALARCLVREQPILLLDEPFSALDPALRQEMLTLVSTSCQQQKMTLLMVSHSVEDAARIATRSVVVADGRIAWQGMTNELLSGKASASALLGITG

SEQ ID NO: 1193 - protein, 290 aa, Escherichia coli
MLAFTWIALRFIHFTSLMLVFGFAMYGAWLAPLTIRRLLAKRFLRLQQHAAVWSLISATAMLAVQGGLMGTGWTDVFSPNIWQAVLQTQFGGIWLWQIVLALVTLIVALMQPRNMPRLLFMLTTAQFILLAGVGHATLNEGVTAKIHQTNHAIHLICAAAWFGGLLPVLWCMQLIKGRWRHQAIQALMRFSWCGHFAVIGVLASGVLNALLITGFPPTLTTYWGQLLLLKAILVMIMVVIALANRYVLVPRMRQDEDRAAPWFVWMTKLEWAIGAVVLVIISLLATLEPF

SEQ ID NO: 1194 - protein, 327 aa, Escherichia coli
MEAIKGSDVNVPDAVFAWMLDGRGGVKPLENTDVIDEAHPCWLHLNYVHHDSAQWLATTPLLPNNVRDALAGESTRPRVSRLGEGTLITLRCINGSTDERPDQLVAMRVYMDGRLIVSTRQRKVLALDDVVSDLEEGTGPTDCGGWLVDVCDALTDHSSEFIEQLHDKIIDLEDNLLDQQIPPRGFLALLRKQLIVMRRYMAPQRDVYARLASERLPWMSDDQRRRMQDIADRLGRGLDEIDACIARTGVMADEIAQVMQENLARRTYTMSLMAMVFLPSTFLTGLFGVNLGGIPGGGWQFGFSIFCILLVVLIGGVALWLHRSKWL

SEQ ID NO: 1195 - protein, 263 aa, Escherichia coli
MGSEISKKDITRLGFRSSLLQASFNYERMQAGGFTWAMLPILKKIYKDDKPGLSAAMKDNLEFINTHPNLVGFLMGLLISMEEKGENRDTIKGLKVALFGPIAGIGDAIFWFTLLPIMAGICSSFASQGNLLGPILFFAVYLLIFFLRVGWTHVGYSVGVKAIDKVRENSQMIARSATILGITVIGGLIASYVHINVVTSFAIDNTHSVALQQDFFDKVFPNILPMAYTLLMYYFLRVKKAHPVLLIGVTFVLSIVCSAFGIL

SEQ ID NO: 1196 - protein, 451 aa, Escherichia coli
MFSEVMRYILDLGPTVMLPIVIIIFSKILGMKAGDCFKAGLHIGIGFVGIGLVIGLMLDSIGPAAKAMAENFDLNLHVVDVGWPGSSPMTWASQIALVAIPIAILVNVAMLLTRMTRVVNVDIWNIWHMTFTGALLHLATGSWMIGMAGVVIHAAFVYKLGDWFARDTRNFFELEGIAIPHGTSAYMGPIAVLVDAIIEKIPGVNRIKFSADDIQRKFGPFGEPVTVGFVMGLIIGILAGYDVKGVLQLAVKTAAVMLLMPRVIKPIMDGLTPIAKQARSRLQAKFGGQEFLIGLDPALLLGHTAVVSASLIFIPLTILIAVCVPGNQVLPFGDLATIGFFVAMAVAVHRGNLFRTLISGVIIMSITLWIATQTIGLHTQLAANAGALKAGGMVASMDQGGSPITWLLIQVFSPQNIPGFIIIGAIYLTGIFMTWRRARGFIKQEKVVLAE

SEQ ID NO: 1197 - protein, 230 aa, Escherichia coli
MTDMNILDLFLKASLLVKLIMLILIGFSIASWAIIIQRTRILNAAAREAEAFEDKFWSGIELSRLYQESQGKRDNLTGSEQIFYSGFKEFVRLHRANSHAPEAVVEGASRAMRISMNRELENLETHIPFLGTVGSISPYIGLFGTVWGIMHAFIALGAVKQATLQMVAPGIAEALIATAIGLFAAIPAVMAYNRLNQRVNKLELNYDNFMEEFTAILHRQAFTVSESNKG

SEQ ID NO: 1198 - protein, 308 aa, Escherichia coli
MKNQAHPIIVVKRRKAKSHGAAHGSWKIAYADFMTAMMAFFLVMWLISISSPKELIQIAEYFRTPLATAVTGGDRISNSESPIPGGGDDYTQSQGEVNKQPNIEELKKRMEQSRLRKLRGDLDQLIESDPKLRALRPHLKIDLVQEGLRIQIIDSQNRPMFRTGSADVEPYMRDILRAIAPVLNGIPNRISLSGHTDDFPYASGEKGYSNWELSADRANASRRELMVGGLDSGKVLRVVGMAATMRLSDRGPDDAVNRRISLLVLNKQAEQAILHENAESQNEPVSALEKPEVAPQVSVPTMPSAEPR

SEQ ID NO: 1199 - protein, 89 aa, Escherichia coli
MGGISIWQLLIIAVIVVLLFGTKKLGSIGSDLGASIKGFKKAMSDDEPKQDKTSQDADFTAKTIADKQADTNQEQAKTEDAKRHDKEQV

SEQ ID NO: 1200 - protein, 416 aa, Escherichia coli
MDVMRSVLGMVVLLTIAFLLSVNKKKISLRTVGAALVLQVVIGGIMLWLPPGRWVAEKVAFGVHKVMAYSDAGSAFIFGSLVGPKMDTLFDGAGFIFGFRVLPAIIFVTALVSILYYIGVMGILIRILGGIFQKALNISKIESFVAVTTIFLGQNEIPAIVKPFIDRLNRNELFTAICSGMASIAGSTMIGYAALGVPVEYLLAASLMAIPGGILFARLLSPATESSQVSFNNLSFTETPPKSIIEAAATGAMTGLKIAAGVATVVMAFVAIIALINGIIGGVGGWFGFEHASLESILGYLLAPLAWVMGVDWSDANLAGSLIGQKLAINEFVAYLNFSPYLQTAGTLDAKTVAIISFALCGFANFGSIGVVVGAFSAVAPHRAPEIAQLGLRALAAATLSNLMSATIAGFFIGLA

SEQ ID NO: 1201 - protein, 473 aa, Escherichia coli
MMSKINQTDIDRLIELVGGRGNIATVSHCITRLRFVLNQPANARPKEIEQLPMVKGCFTNAGQFQVVIGTNVGDYYQALIASTGQAQVDKEQVKKAARHNMKWHEQLISHFAVIFFPLLPALISGGLILGFRNVIGDLPMSNGQTLAQMYPSLQTIYDFLWLIGEAIFFYLPVGICWSAVKKMGGTPILGIVLGVTLVSPQLMNAYLLGQQLPEVWDFGMFSIAKVGYQAQVIPALLAGLALGVIETRLKRIVPDYLYLVVVPVCSLILAVFLAHALIGPFGRMIGDGVAFAVRHLMTGSFAPIGAALFGFLYAPLVITGVHQTTLAIDLQMIQSMGGTPVWPLIALSNIAQGSAVIGIIISSRKHNEREISVPAAISAWLGVTEPAMYGINLKYRFPMLCAMIGSGLAGLLCGLNGVMANGIGVGGLPGILSIQPSYWQVFALAMAIAIIIPIVLTSFIYQRKYRLGTLDIV

SEQ ID NO: 1202 - protein, 577 aa, Escherichia coli
MRYIRQLCCVSLLCLSGSAVAANVRLQVEGLSGQLEKNVRAQLSTIESDEVTPDRRFRARVDDAIREGLKALGYYQPTIEFDLRPPPKKGRQVLIAKVTPGVPVLIGGTDVVLRGGARTDKDYLKLLDTRPAIGTVLNQGDYENFKKSLTSIALRKGYFDSEFTKAQLGIALGLHKAFWDIDYNSGERYRFGHVTFEGSQIRDEYLQNLVPFKEGDEYESKDLAELNRRLSATGWFNSVVVAPQFDKARETKVLPLTGVVSPRTENTIETGVGYSTDVGPRVKATWKKPWMNSYGHSLTTSTSISAPEQTLDFSYKMPLLKNPLEQYYLVQGGFKRTDLNDTESDSTTLVASRYWDLSSGWQRAINLRWSLDHFTQGEITNTTMLFYPGVMISRTRSRGGLMPTWGDSQRYSIDYSNTAWGSDVDFSVFQAQNVWIRTLYDRHRFVTRGTLGWIETGDFDKVPPDLRFFAGGDRSIRGYKYKSIAPKYANGDLKGASKLITGSLEYQYNVTGKWWGAVFVDSGEAVSDIRRSDFKTGTGVGVRWESPVGPIKLDFAVPVADKDEHGLQFYIGLGPEL

SEQ ID NO: 1203 - protein, 319 aa, Escherichia coli
MAATKPAFNPPGKKGDIIFSVLVKLAALIVLLMLGGIIVSLIISSWPSIQKFGLAFLWTKEWDAPNDIYGALVPIYGTLVTSFIALLIAVPVSFGIALFLTELAPGWLKRPLGIAIELLAAIPSIVYGMWGLFIFAPLFAVYFQEPVGNIMSNIPIVGALFSGPAFGIGILAAGVILAIMIIPYIAAVMRDVFEQTPVMMKESAYGIGCTTWEVIWRIVLPFTKNGVIGGIMLGLGRALGETMAVTFIIGNTYQLDSASLYMPGNSITSALANEFAEAESGLHVAALMELGLILFVITFIVLAASKFMIMRLAKNEGAR

SEQ ID NO: 1204 - protein, 439 aa, Escherichia coli
MLPFLKAPADAPLMTDKYEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 1205 - protein, 578 aa, Escherichia coli
MNDAVITLNGLEKRFPGMDKPAVAPLDCTIHAGYVTGLVGPDGAGKTTLMRMLAGLLKPDSGSATVIGFDPIKNDGALHAVLGYMPQKFGLYEDLTVMENLNLYADLRSVTGEARKQTFARLLEFTSLGPFTGRLAGKLSGGMKQKLGLACTLVGEPKVLLLDEPGVGVDPISRRELWQMVHELAGEGMLILWSTSYLDEAEQCRDVLLMNEGELLYQGEPKALTQTMAGRSFLMTSPHEGNRKLLQRALKLPQVSDGMIQGKSVRLILKKEATPDDIRHADGMPEININETTPRFEDAFIDLLGGAGTSESPLGAILHTVEGTPGETVIEAKELTKKFGDFAATDHVNFAVKRGEIFGLLGPNGAGKSTTFKMMCGLLVPTSGQALVLGMDLKESSGKARQHLGYMAQKFSLYGNLTVEQNLRFFSGVYGLRGRAQNEKISRMSEAFGLKSIASHATDELPLGFKQRLALACSLMHEPDILFLDEPTSGVDPLTRREFWLHINSMVEKGVTVMVTTHFMDEAEYCDRIGLVYRGKLIASGTPDDLKAQSANDEQPDPTMEQAFIQLIHDWDKEHSNE

SEQ ID NO: 1206 - protein, 477 aa, Escherichia coli
MSDTKRNTIGKFGLLSLTFAAVYSFNNVINNNIELGLASAPMFFLATIFYFIPFCLIIAEFVSLNKNSEAGVYAWVKSSLGGRWAFITAYTYWFVNLFFFTSLLPRVIAYASYAFLGYEYIMTPVATTIISMVLFAFSTWVSTNGAKMLGPITSVTSTLMLLLTLSYILLAGTALVGGVQPADAITVDAMIPNFNWAFLGVTTWIFMAAGGAESVAVYVNDVKGGSKSFVKVIILAGIFIGVLYSVSSVLINVFVSSKELKFTGGSVQVFHGMAAYFGLPEALMNRFVGLVSFTAMFGSLLMWTATPVKIFFSEIPEGIFGKKTVELNENGVPARAAWIQFLIVIPLMIIPMLGSNTVQDLMNTIINMTAAASMLPPLFIMLAYLNLRAKLDHLPRDFRMGSRRTGIIVVSMLIAIFAVGFVASTFPTGANILTIIFYNVGGIVIFLGFAWWKYSKYIKGLTAEERHIEATPASNVD

SEQ ID NO: 1207 - protein, 339 aa, Escherichia coli
MLQFILRRLGLVIPTFIGITLLTFAFVHMIPGDPVMIMAGERGISPERHAQLLAELGLDKPMWQQYLHYIWGVMHGDLGISMKSRIPVWEEFVPRFQATLELGVCAMIFATAVGIPVGVLAAVKRGSIFDHTAVGLALTGYSMPIFWWGMMLIMLVSVHWNLTPVSGRVSDMVFLDDSNPLTGFMLIDTAIWGEDGNFIDAVAHMILPAIVLGTIPLAVIVRMTRSSMLEVLGEDYIRTARAKGLTRMRVIIVHALRNAMLPVVTVIGLQVGTLLAGAILTETIFSWPGLGRWLIDALQRRDYPVVQGGVLLVATMIILVNLLVDLLYGVVNPRIRHKK

SEQ ID NO: 1208 - protein, 425 aa, Escherichia coli
MQHNSYRRWITLAIISFSGGVSFDLAYLRYIYQIPMAKFMGFSNTEIGLIMSTFGIAAIILYAPSGVIADKFSHRKMITSAMIITGLLGLLMATYPPLWVMLCIQIAFAITTILMLWSVSIKAASLLGDHSEQGKIMGWMEGLRGVGVMSLAVFTMWVFSRFAPDDSTSLKTVIIIYSVVYILLGILCWFFVSDNNNLRSANNEEKQSFQLSDILAVLRISTTWYCSMVIFGVFTIYAILSYSTNYLTEMYGMSLVAASYMGIVINKIFRALCGPLGGIITTYSKVKSPTRVIQILSVLGLLTLTALLVTNSNPQSVAMGIGLILLLGFTCYASRGLYWACPGEARTPSYIMGTTVGICSVIGFLPDVFVYPIIGHWQDTLPAAEAYRNMWLMGMAALGMVIVFTFLLFQKIRTADSAPAMASSK

SEQ ID NO: 1209 - protein, 499 aa, Escherichia coli
MLHLFAGLDLHTGLLLLLALAFVLFYEAINGFHDTANAVATVIYTRAMRSQLAVVMAAVFNFLGVLLGGLSVAYAIVHMLPTDLLLNMGSSHGLAMVFSMLLAAIIWNLGTWYFGLPASSSHTLIGAIIGIGLTNALMTGTSVVDALNIPKVLSIFGSLIVSPIVGLVFAGGLIFLLRRYWSGTKKRARIHLTPAEREKKDGKKKPPFWTRIALILSAIGVAFSHGANDGQKGIGLVMLVLIGVAPAGFVVNMNATGYEITRTRDAINNVEAYFEQHPALLKQATGADQLVPAPEAGATQPAEFHCHPSNTINALNRLKGMLTTDVESYDKLSLDQRSQMRRIMLCVSDTIDKVVKMPGVSADDQRLLKKLKSDMLSTIEYAPVWIIMAVALALGIGTMIGWRRVATTIGEKIGKKGMTYAQGMSAQMTAAVSIGLASYTGMPVSTTHVLSSSVAGTMVVDGGGLQRKTVTSILMAWVFTLPAAVLLSGGLYWLSLQFL

SEQ ID NO: 1210 - protein, 295 aa, Escherichia coli
MPGSLRKMPVWLPIVILLVAMASIQGGASLAKSLFPLVGAPGVTALRLALGTLILIAFFKPWRLRFAKEQRLPLLFYGVSLGGMNYLFYLSIQTVPLGIAVALEFTGPLAVALFSSRRPVDFVWVVLAVLGLWFLLPLGQDVSHVDLTGCALALGAGACWAIYILSGQRAGAEHGPATVAIGSLIAALIFVPIGALQAGEALWHWSVIPLGLAVAILSTALPYSLEMIALTRLPTRTFGTLMSMEPALAAVSGMIFLGETLTPIQLLALGAIIAASMGSTLTVRKESKIKELDIN

SEQ ID NO: 1211 - protein, 142 aa, Escherichia coli
MARARGRGRRDLKSEINIVPLLDVLLVLLLIFMATAPIITQSVEVDLPDATESQAVSSNDNPPVIVEVSGIGQYTVVVEKDRLERLPPEQVVAEVSSRFKANPKTVFLIGGAKDVPYDEIIKALNLLHSAGVKSVGLMTQPI

SEQ ID NO: 1212 - protein, 732 aa, Escherichia coli
MSTPDNHGKKAPQFAAFKPLTTVQNANDCCCDGACSSTPTLSENVSGTRYSWKVSGMDCAACARKVENAVRQLAGVNQVQVLFATEKLVVDADNDIRAQVESALQKAGYSLRDEQAAEEPQASRLKENLPLITLIVMMAISWGLEQFNHPFGQLAFIATTLVGLYPIARQALRLIKSGSYFAIETLMSVAAIGALFIGATAEAAMVLLLFLIGERLEGWAASRARQGVSALMALKPETATRLRKGEREEVAINSLRPGDVIEVAAGGRLPADGKLLSPFASFDESALTGESIPVERATGDKVPAGATSVDRLVTLEVLSEPGASAIDRILKLIEEAEERRAPIERFIDRFSRIYTPAIMAVALLVTLVPPLLFAASWQEWIYKGLTLLLIGCPCALVISTPAAITSGLAAAARRGALIKGGAALEQLGRVTQVAFDKTGTLTVGKPRVTAIHPATGISESELLTLAAAVEQGATHPLAQAIVREAQVAELAIPTAESQRALVGSGIEAQVNGERVLICAAGKHPADAFTGLINELESAGQTVVLVVRNDDVLGVIALQDTLRADAATAISELNALGVKGVILTGDNPRAAAAIAGELGLEFKAGLLPEDKVKAVTELNQHAPLAMVGDGINDAPAMKAAAIGIAMGSGTDVALETADAALTHNHLRGLVQMIELARATHANIRQNITIALGLKGIFLVTTLLGMTGLWLAVLADTGATVLVTANALRLLRRR

SEQ ID NO: 1213 - protein, 553 aa, Escherichia coli
MSDIALTVSILALVAVVGLFIGNVKFRGIGLGIGGVLFGGIIVGHFVSQAGMTLSSDMLHVIQEFGLILFVYTIGIQVGPGFFASLRVSGLRLNLFAVLIVIIGGLVTAILHKLFDIPLPVVLGIFSGAVTNTPALGAGQQILRDLGTPMEMVDQMGMSYAMAYPFGICGILFTMWMLRVIFRVNVETEAQQHESSRTNGGALIKTINIRVENPNLHDLAIKDVPILNGDKIICSRLKREETLKVPSPDTIIQLGDLLHLVGQPADLHNAQLVIGQEVDTSLSTKGTDLRVERVVVTNENVLGKRIRDLHFKERYDVVISRLNRAGVELVASGDISLQFGDILNLVGRPSAIDAVANVLGNAQQKLQQVQMLPVFIGIGLGVLLGSIPVFVPGFPAALKLGLAGGPLIMALILGRIGSIGKLYWFMPPSANLALRELGIVLFLSVVGLKSGGDFVNTLVNGEGLSWIGYGALITAVPLITVGILARMLAKMNYLTMCGMLAGSMTDPPALAFANNLHPTSGAAALSYATVYPLVMFLRIITPQLLAVLFWSIG

SEQ ID NO: 1214 - protein, 503 aa, Escherichia coli
MFTATEAVPVAKVVAGNKRYPGVVALDNVNFTLNKGEVRALLGKNGAGKSTLIRMLTGSERPDSGDIWIGETRLEGDEATLTRRAAELGVRAVYQELSLVEGLTVAENLCLGQWPRRNGMIDYLQMAQDAQRCLQALGVDVSPEQLVSTLSPAQKQLVEIARVMKGEPRVVILDEPTSSLASAEVELVISAVKKMSALGVAVIYVSHRMEEIRRIASCATVMRDGQVAGDVMLENTSTHHIVSLMLGRDHVDIAPVAPQEIVDQAVLEVRALRHKPKLEDISFTLRRGEVLGIAGLLGAGRSELLKAIVGLEEYEQGEIVINGEKITRPDYGDMLKRGIGYTPENRKEAGIIPWLGVDENTVLTNRQKISANGVLQWSTIRRLTEEVMQRMTVKAASSETPIGTLSGGNQQKVVIGRWVYAASQILLLDEPTRGVDIEAKQQIYRIVRELAAEGKSVVFISSEVEELPLVCDRILLLQHGTFSQEFHAPVNVDELMSAILSVH

SEQ ID NO: 1215 - protein, 367 aa, Escherichia coli
MKVKVLSLLVPALLVAGAANAAEVYNKDGNKLDLYGKVDGLHYFSDNKDVDGDQTYMRLGFKGETQVTDQLTGYGQWEYQIQGNSAENENNSWTRVAFAGLKFQDVGSFDYGRNYGVVYDVTSWTDVLPEFGGDTYGSDNFMQQRGNGFATYRNTDFFGLVDGLNFAVQYQGKNGNPSGEGFTSGVTNNGRDALRQNGDGVGGSITYDYEGFGIGGAISSSKRTDAQNTAAYIGNGDRAETYTGGLKYDANNIYLAAQYTQTYNATRVGSLGWANKAQNFEAVAQYQFDFGLRPSLAYLQSKGKNLGRGYDDEDILKYVDVGATYYFNKNMSTYVDYKINLLDDNQFTRDAGINTDNIVALGLVYQF

SEQ ID NO: 1216 - protein, 158 aa, Escherichia coli
MTSPNILLTRIDNRLVHGQVGVTWTSTIGANLLVVVDDVVANDDIQQKLMGITAETYGFGIRFFTIEKTINVIGKAAPHQKIFLICRTPQTVRKLVEGGIDLKDVNVGNMHFSEGKKQISSKVYVDDQDLTDLRFIKQRGVNVFIQDVPGDQKEQIPD

SEQ ID NO: 1217 - protein, 415 aa, Escherichia coli
MAIKKRSATVVPGASGAAAAVKNPQASKTSFWGELPQHVMSGISRMVPTLIMGGVILAFSQLIAYSWLKIPAEIGIMDALNSGKFSGFDLSLLKFAWLSQSFGGVLFGFAIPMFAAFVANSIGGKLAFPAGFIGGLMSTQPTQLLNFDPSTMQWATSSPVPSTFIGALIISIVAGYLVKWMNQKIQLPDFLLAFKTTFLLPILSAIFVMLAMYYVITPFGGWINGGIRTVLTAAGEKGALMYAMGIAAATAIDLGGPINKAAGFVAFSFTTDHVLPVTARSIAIVIPPIGLGLATIIDRRLTGKRLFNAQLYPQGKTAMFLAFMGISEGAIPFALESPITAIPSYMVGAIVGSTAAVWLGAVQWFPESAIWAWPLVTNLGVYMAGIALGAVITALMVVFLRLMMFRKGKLLIDSL

SEQ ID NO: 1218 - protein, 230 aa, Escherichia coli
MKKINAIILLSSLTSASVFAGAYVENREAYNLASDQGEVMLRVGYNFDMGAGIMLTNTYNFQREDELKHGYNEIEGWYPLFKPTDKLTIQPGGLINDKSIGSGGAVYLDVNYKFVPWFNLTVRNRYNHNNYSSTDLSGELDNNDTYEIGTYWNFKITDKFSYTFEPHYFMRVNDFNSSNGKDHHWEITNTFRYRINEHWLPYFELRWLDRNVEPYHREQNQIRIGTKYFF

SEQ ID NO: 1219 - protein, 344 aa, Escherichia coli
MSNAITMGIFWHLIGAASAACFYAPFKKVKKWSWETMWSVGGIVSWIILPWAISALLLPNFWAYYSSFSLSTRLPVFLFGAMWGIGNINYGLTMRYLGMSMGIGIAIGITLIVGTLMTPIINGNFDVLISTEGGRMTLLGVLVALIGVGIVTRAGQLKERKMGIKAEEFNLKKGLVLAVMCGIFSAGMSFAMNAAKPMHEAAAALGVDPLYVALPSYVVIMGGGAIINLGFCFIRLAKVKDLSLKADFSLAKSLIIHNVLLSTLGGLMWYLQFFFYAWGHARIPAQYDYISWMLHMSFYVLCGGIVGLVLKEWNNAGRRPVTVLSLGCVVIIVAANIVGIGMAN

SEQ ID NO: 1220 - protein, 296 aa, Escherichia coli
MDAKQTRQGVLLALAAYFIWGIAPAYFKLIYYVPADEILTHRVIWSFFFMVVLMSICRQWSYLKTLIQTPQKIFMLAVSAVLIGGNWLLFIWAVNNHHMLEASLGYFINPLVNIVLGMIFLGERFRRMQWLAVILAICGVLVQLWTFGSLPIIALGLAFSFAFYGLVRKKIAVEAQTGMLIETMWLLPVAAIYLFAIADSSTSHMGQNPMSLNLLLIAAGIVTTVPLLCFTAAATRLRLSTLGFFQYIGPTLMFLLAVTFYGEKPGADKMVTFAFIWVALAIFVMDAIYTQRRTSK

SEQ ID NO: 1221 - protein, 648 aa, Escherichia coli
MNILGFFQRLGRALQLPIAVLPVAALLLRFGQPDLLNVAFIAQAGGAIFDNLALIFAIGVASSWSKDSAGAAALAGAVGYFVLTKAMVTINPEINMGVLAGIITGLVGGAAYNRWSDIKLPDFLSFFGGKRFVPIATGFFCLVLAAIFGYVWPPVQHAIHAGGEWIVSAGALGSGIFGFINRLLIPTGLHQVLNTIAWFQIGEFTNAAGTVFHGDINRFYAGDGTAGMFMSGFFPIMMFGLPGAALAMYFAAPKERRPMVGGMLLSVAVTAFLTGVTEPLEFLFMFLAPLLYLLHALLTGISLFVATLLGIHAGFSFSAGAIDYALMYNLPAASQNVWMLLVMGVIFFAIYFVVFSLVIRMFNLKTPGREDKEDEIVTEEANSNTEEGLTQLATNYIAAVGGTDNLKAIDACITRLRLTVADSARVNDTMCKRLGASGVVKLNKQTIQVIVGAKAESIGDAMKKVVARGPVAAASAEATPATAAPVAKPQAVPNAVSIAELVSPITGDVVALDQVPDEAFASKAVGDGVAVKPTDKIVVSPAAGTIVKIFNTNHAFCLETEKGAEIVVHMGIDTVALEGKGFKRLVEEGAQVSAGQPILEMDLDYLNANARSMISPVVCSNIDDFSGLIIKAQGHIVAGQTPLYEIKK

SEQ ID NO: 1222 - protein, 169 aa, Escherichia coli [sequence omitted]

SEQ ID NO: 1223 - protein, 281 aa, Escherichia coli
MNNLPVVRSPWRIVILLLGFTFLYAPMLMLVIYSFNSSKLVTVWAGWSTRWYGELLRDDAMMSAVGLSLTIAACAATAAAILGTIAAVVLVRFGRFRGSNGFAFMITAPLVMPDVITGLSLLLLFVALAHAIGWPADRGMLTIWLAHVTFCTAYVAVVISSRLRELDRSIEEAAMDLGATPLKVFFVITLPMIMPAIISGWLLAFTLSLDDLVIASFVSGPGATTLPMLVFSSVRMGVNPEINALATLILGAVGIVGFIAWYLMARAEKQRIRDIQRARRG

SEQ ID NO: 1224 - protein, 417 aa, Escherichia coli
MCEHHHAAKHILCSQCDMLVALPRLEHGQKAACPRCGTTLTVAWDAPRQRPTAYALAALFMLLLSNLFPFVNMNVAGVTSEITLLEIPGVLFSEDYASLGTFFLLFVQLVPAFCLITILLLVNRAELPVRLKEQLARVLFQLKTWGMAEIFLAGVLVSFVKLMAYGSIGVGSSFLPWCLFCVLQLRAFQCVDRRWLWDDIAPMPELRQPLKPGVTGIRQGLRSCSCCTAILPADEPVCPRCSTKGYVRRRNSLQWTLALLVTSIMLYLPANILPIMVTDLLGSKMPSTILAGVILLWSEGSYPVAAVIFLASIMVPTLKMIAIAWLCWDAKGHGKRDSERMHLIYEVVEFVGRWSMIDVFVIAVLSALVRMGGLMSIYPAMGALMFALVVIMTMFSAMTFDPRLSWDRQPESEHEES

SEQ ID NO: 1225 - protein, 229 aa, Escherichia coli
MARRILVVEDEAPIREMVCFVLEQNGFQPVEAEDYDSAVNQLNEPWPDLILLDWMLPGGSGIQFIKHLKRESMTRDIPVVMLTARGEEEDRVRGLETGADDYITKPFSPKELVARIKAVMRRISPMAVEEVIEMQGLSLDPTSHRVMAGEEPLEMGPTEFKLLHFFMTHPERVYSREQLLNHVWGTNVYVEDRTVDVHIRRLRKALEPGGHDRMVQTVRGTGYRFSTRF

SEQ ID NO: 1226 - protein, 500 aa, Escherichia coli
MLKRKKVKPITLRDVTIIDDGKLRKAITAASLGNAMEWFDFGVYGFVAYALGKVFFPGADPSVQMVAALATFSVPFLIRPLGGLFFGMLGDKYGRQKILAITIVIMSISTFCIGLIPSYDTIGIWAPILLLICKMAQGFSVGGEYTGASIFVAEYSPDRKRGFMGSWLDFGSIAGFVLGAGVVVLISTIVGEANFLDWGWRIPFFIALPLGIIGLYLRHALEETPAFQQHVDKLEQGDREGLQDGPKVSFKEIATKYWRSLLTCIGLVIATNVTYYMLLTYMPSYLSHNLHYSEDHGVLIIIAIMIGMLFVQPVMGLLSDRFGRRPFVLLGSVALFVLAIPAFILINSNVIGLIFAGLLMLAVILNCFTGVMASTLPAMFPTHIRYSALAAAFNISVLVAGLTPTLAAWLVESSQNLMMPAYYLMVVAVVGLITGVTMKETANRPLKGATPAASDIQEAKEILVEHYDNIEQKIDDIDHEIADLQAKRTRLVQQHPRIDE

SEQ ID NO: 1227 - protein, 370 aa, Escherichia coli
MTALNKKWLSGLVAGALMAVSVGTLAAEQKTLHIYNWSDYIAPDTVANFEKETGIKVVYDVFDSNEVLEGKLMAGSTGFDLVVPSASFLERQLTAGVFQPLDKSKLPEWKNLDPELLKLVAKHDPDNKFAMPYMWATTGIGYNVDKVKAVLGENAPVDSWDLILKPENLEKLKSCGVSFLDAPEEVFATVLNYLGKDPNSTKADDYTGPATDLLLKLRPNIRYFHSSQYINDLANGDICVAIGWAGDVWQASNRAKEAKNGVNVSFSIPKEGAMAFFDVFAMPADAKNKDEAYQFLNYLLRPDVVAHISDHVFYANANKAATPLVSAEVRENPGIYPPADVRAKLFTLKVQDPKIDRVRTRAWTKVKSGK

SEQ ID NO: 1228 - protein, 396 aa, Escherichia coli
MSEFIAENRGADAITRPNWSAVFSVAFCVACLIIVEFLPVSLLTPMAQDLGISEGVAGQSVTVTAFVAMFASLFITQTIQATDRRYVVILFAVLLTLSCLLVSFANSFSLLLIGRACLGLALGGFWAMSASLTMRLVPPRTVPKALSVIFGAVSIALVIAAPLGSFLGELIGWRNVFNAAAVMGVLCIFWIIKSLPSLPGEPSHQKQNTFRLLQRPGVMAGMIAIFMSFAGQFAFFTYIRPVYMNLAGFGVDGLTLVLLSFGIASFIGTSLSSFILKRSVKLALAGAPLILAVSALVLTLWGSDKIVATGVAIIWGLTFALVPVGWSTWITRSLADQAEKAGSIQVAVIQLANTCGAAIGGYALDNIGLTSPLMLSGTLMLLTALLVTAKVKMKKS

SEQ ID NO: 1229 - protein, 833 aa, Escherichia coli
MALIVEFICELPNGVHARPASHVETLCNTFSSQIEWHNLRTDRKGNAKSALALIGTDTLAGDNCQLLISGADEQEAHQRLSQWLRDEFPHCDAPLAEVKSDELEPLPVSLTNLNPQIIRARTVCSGSAGGILTPISSLDLNALGNLPAAKGVDAEQSALENGLTLVLKNIEFRLLDSDGATSAILEAHRSLAGDTSLREHLLAGVSAGLSCAEAIVASANHFCEEFSRSSSSYLQERALDVRDVCFQLLQQIYGEQRFPAPGKLTQPAICMADELTPSQFLELDKNHLKGLLLKSGGTTSHTVILARSFNIPTLVGVDIDALTPWQQQTIYIDGNAGAIVVEPGEAVARYYQQEARVQDALREQQRVWLTQQARTADGIRIEIAANIAHSVEAQAAFGNGAEGVGLFRTEMLYMDRTSAPGESELYNIFCQALESANGRSIIVRTMDIGGDKPVDYLNIPAEANPFLGYRAVRIYEEYASLFTTQLRSILRASAHGSLKIMIPMISSMEEILWVKEKLAEAKQQLRNEHIPFDEKIQLGIMLEVPSVMFIIDQCCEEIDFFSIGSNDLTQYLLAVDRDNAKVTRHYNSLNPAFLRALDYAVQAVHRQGKWIGLCGELGAKGSVLPLLVGLGLDELSMSAPSIPAAKARMAQLDSRECRKLLNQAMACRTSLEVEHLLAQFRMTQQDAPLVTAECITLESDWRSKEEVLKGMTDNLLLAGRCRYPRKLEADLWAREAVFSTGLGFSFAIPHSKSEHIEQSTISVARLQAPVRWGDDEAQFIIMLTLNKHAAGDQHMRIFSRLARRIMHEEFRNALVNAASADAIASLLQHELEL

SEQ ID NO: 1230 - protein, 575 aa, Escherichia coli
MISGILASPGIAFGKALLLKEDEIVIDRKKISADQVDQEVERFLSGRAKASAQLETIKTKAGETFGEEKEAIFEGHIMLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAIRIAMDRREILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 1231 - protein, 388 aa, Escherichia coli
MKHLHRFFSSDASGGIILIIAAILAMIMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLAVLNLCGARRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMVVGILCGIGFTMSIFIASLAFGSVDPELINWAKLGILVGSISSAVIGYSWLRVRLRPSV

SEQ ID NO: 1232 - protein, 530 aa, Escherichia coli
MTAKTAPKVTLWEFFQQLGKTFMLPVALLSFCGIMLGIGSSLSSHDVITLIPVLGNPVLQAIFTWMSKIGSFAFSFLPVMFCIAIPLGLARENKGVAAFAGFIGYAVMNLAVNFWLTNKGILPTTDAAVLKANNIQSILGIQSIDTGILGAVIAGIIVWMLHERFHNIRLPDALAFFGGTRFVPIISSLVMGLVGLVIPLVWPIFAMGISGLGHMINSAGDFGPMLFGTGERLLLPFGLHHILVALIRFTDAGGTQEVCGQTVSGALTIFQAQLSCPTTHGFSESATRFLSQGKMPAFLGGLPGAALAMYHCARPENRHKIKGLLISGLIACVVGGTTEPLEFLFLFVAPVLYVIHALLTGLGFTVMSVLGVTIGNTDGNIIDFVVFGILHGLSTKWYMVPVVAAIWFVVYYVIFRFAITRFNLKTPGRDSEVASSIEKAVAGAPGKSGYNVPAILEALGGADNIVSLDNCITRLRLSVKDMSLVNVQALKDNRAIGVVQLNQHNLQVVIGPQVQSVKDEMAGLMHTVQA

SEQ ID NO: 1233 - protein, 200 aa, Escherichia coli
MGNSDRKPGLIKRLWKWWRTPSRLALGTLLLIGFVGGIVFWGGFNTGMEKANTEEFCISCHEMRNTVYQEYMDSVHYNNRSGVRATCPDCHVPHEFVPKMIRKLKASKELYGKIFGVIDTPQKFEAHRLTMAQNEWRRMKDNNSQECRNCHNFEYMDTTAQKSVAAKMHDQAVKDGQTCIDCHKGIAHKLPDMREVEPGF

SEQ ID NO: 1234 - protein, 277 aa, Escherichia coli
MNFFLSSRWSVRLALIIIALLALIALTSQWWLPYDPQAIDLPSRLLSPDAQHWLGTDHLGRDIFSRLMAATRVSLGSVMACLLLVLTLGLVIGGSAGLIGGRVDQATMRVADMFMTFPTSILSFFMVGVLGTGLTNVIIAIALSHWAWYARMVRSLVISLRQREFVLASRLSGAGHVRVFVDHLAGAVIPSLLVLATLDIGHMMLHVAGMSFLGLGVTAPTAEWGVMINDARQYIWTQPLQMFWPGLALFISVMAFNLVGDALRDHLDPHLVTEHAH

SEQ ID NO: 1235 - protein, 908 aa, Escherichia coli
MATIHVDGKEYEVNGADNLLEACLSLGLDIPYFCWHPALGSVGACRQCAVKQYQNAEDTRGRLVMSCMTPASDGTFISIDDEEAKQFRESVVEWLMTNHPHDCPVCEEGGNCHLQDMTVMTGHSFRRYRFTKRTHRNQDLGPFISHEMNRCIACYRCVRYYKDYADGTDLGVYGAHDNVYFGRPEDGTLESEFSGNLVEICPTGVFTDKTHSERYNRKWDMQFAPSICQQCSIGCNISPGERYGELRRIENRYNGTVNHYFLCDRGRFGYGYVNLKDRPRQPVQRRGDDFITLNAEQAMQGAADILRQSKKVIGIGSPRASVESNFALRELVGEENFYTGIAHGEQERLQLALKVLREGGIYTPALREIESYDAVLVLGEDVTQTGARVALAVRQAVKGKAREMAAAQKVADWQIAAILNIGQRAKHPLFVTNVDDTRLDDIAAWTYRAPVEDQARLGFAIAHALDNSAPAVDGIEPELQSKIDVIVQALAGAKKPLIISGTNAGSLEVIQAAANVAKALKGRGADVGITMIARSVNSMGLGIMGGGSLEEALTELETGRADAVVVLENDLHRHASAIRVNAALAKAPLVMVVDHQRTAIMENAHLVLSAASFAESDGTVINNEGRAQRFFQVYDPAYYDSKTVMLESWRWLHSLHSTLLSREVDWTQLDHVIDAVVAKIPELAGIKDAAPDATFRIRGQKLAREPHRYSGRTAMRANISVHEPRQPQDIDTMFTFSMEGNNQPTAHRSQVPFAWAPGWNSPQAWNKFQDEVGGKLRFGDPGVRLFETSENGLDYFTSVPARFQPQDGKWRIAPYYHLFGSDELSQRAPVFQSRMPQPYIKLNPADAAKLGVNAGTRVSFSYDGNTVTLPVEIAEGLTAGQVGLPMGMSGIAPVLAGAHLEDLKEAQQ

SEQ ID NO: 1236 - protein, 113 aa, Escherichia coli
MAYLVAVTACVSGVAHTYMAAERLEKLCLLEKWGVSIETQGALGTENRLADEDIRRADVALLITDIELAGAERFEHCRYVQCSIYAFLREPQRVMSAVRKVLSAPQQTHLILE

SEQ ID NO: 1237 - protein, 457 aa, Escherichia coli
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 1238 - protein, 598 aa, Escherichia coli
MLKRCLSPLTLVNQVALIVLLSTAIGLAGMAVSGWLVQGVQGSAHAINKAGSLRMQSYRLLAAVPLSEKDKPLIKEMEQTAFSAELTRAAERDGQLAQLQGLQDYWRNELIPALMRAQNRETVSADVSQFVAGLDQLVSGFDRTTEMRIETVVLVHRVMAVFMALLLVFTIIWLRARLLQPWRQLLAMASAVSHRDFTQRANISGRNEMAMLGTALNNMSAELAESYAVLEQRVQEKTAGLEHKNQILSFLWQANRRLHSRAPLCERLSPVLNGLQNLTLLRDIELRVYDTDDEENHQEFTCQPDMTCDDKGCQLCPRGVLPVGDRGTTLKWRLADSHTQYGILLATLPQGRHLSHDQQQLVDTLVEQLTATLALDRHQERQQQLIVMEERATIARELHDSIAQSLSCMKMQVSCLQMQGDALPESSRELLSQIRNELNASWAQLRELLTTFRLQLTEPGLRPALEASCEEYSAKFGFPVKLDYQLPPRLVPSHQAIHLLQIAREALSNALKHSQASEVVVTVAQNDNQVKLTVQDNGCGVPENAIRSNHYGMIIMRDRAQSLRGDCRVRRRESGGTEVVVTFIPEKTFTDVQGDTHE

SEQ ID NO: 1239 - protein, 408 aa, Escherichia coli
MDKLLERFLNYVSLDTQSKAGVRQVPSTEGQWKLLHLLKEQLEEMGLINVTLSEKGTLMATLPANVPGDIPAIGFISHVDTSPDCSGKNVNPQIVENYRGGDIALGIGDEVLSPVMFPVLHQLLGQTLITTDGKTLLGADDKAGIAEIMTALAVLQQKKIPHGDIRVAFTPDEEVGKGAKHFDVDAFDARWAYTVDGGGVGELEFENFNAASVNIKIVGNNVHPGTAKGVMVNALSLAARIHAEVPADESPEMTEGYEGFYHLASMKGTVERADMHYIIRDFDRKQFEARKRKMMEIAKKVGKGLHPDCYIELVIEDSYYNMREKVVEHPHILDIAQQAMRDCDIEPELKPIRGGTDGAQLSFMGLPCPNLFTGGYNYHGKHEFVTLEGMEKAVQVIVRIAELTAQRK

SEQ ID NO: 1240 - protein, 1246 aa, Escherichia coli
MSKLLDRFRYFKQKGETFADGHGQVMHSNRDWEDSYRQRWQFDKIVRSTHGVNCTGSCSWKIYVKNGLVTWEIQQTDYPRTRPDLPNHEPRGCPRGASYSWYLYSANRLKYPLIRKRLIELWREALKQHSDPVLAWASIMNDPQKCLSYKQVRGRGGFIRSNWQELNQLIAAANVWTIKTYGPDRVAGFSPIPAMSMVSYAAGTRYLSLLGGTCLSFYDWYCDLPPASPMTWGEQTDVPESADWYNSSYIIAWGSNVPQTRTPDAHFFTEVRYKGTKTIAITPDYSEVAKLCDQWLAPKQGTDSALAMAMGHVILKEFHLDNPSDYFINYCRRYSDMPMLVMLEPRDDGSYVPGRMIRASDLVDGLGESNNPQWKTVAVNTAGELVVPNGSIGFRWGEKGKWNLESIAAGTETELSLTLLGQHDAVAGVAFPYFGGIENPHFRSVKHNPVLVRQLPVKNLTLVDGNTCPVVSVYDLVLANYGLDRGLEDENSAKDYAEIKPYTPAWGEQITGVPRQYIETIAREFADTAHKTHGRSMIILGAGVNHWYHMDMNYRGMINMLIFCGCVGQSGGGWAHYVGQEKLRPQTGWLPLAFALDWNRPPRQMNSTSFFYNHSSQWRYEKVSAQELLSPLADASKYSGHLIDFNVRAERMGWLPSAPQLGRNPLGIKAEADKAGLSPTEFTAQALKSGDLRMACEQPDSSSNHPRNLFVWRSNLLGSSGKGHEYMQKYLLGTESGIQGEELGASDGIKPEEVEWQTAAIEGKLDLLVTLDFRMSSTCLFSDIVLPTATWYEKDDMNTSDMHPFIHPLSAAVDPAWESRSDWEIYKGIAKAFSQVCVGHLGKETDVVLQPLLHDSPAELSQPCEVLDWRKGECDLIPGKTAPNIVAVERDYPATYERFTSLGPLMDKLGNGGKGISWNTQDEIDFLGKLNYTKRDGPAQGRPLIDTAIDASEVILALAPETNGHVAVKAWQALGEITGREHTHLALHKEDEKIRFRDIQAQPRKIISSPTWSGLESDHVSYNAGYTNVHELIPWRTLSGRQQLYQDHPWMRAFGESLVAYRPPIDTRSVSEMRQIPPNGFPEKALNFLTPHQKWGIHSTYSENLLMLTLSRGGPIVWISETDARELTIVDNDWVEVFNANGALTARAVVSQRVPPGMTMMYHAQERIMNIPGSEVTGMRGGIHNSVTRVCPKPTHMIGGYAQLAWGFNYYGTVGSNRDEFIMIRKMKNVNWLDDEGRDQVQEAKK

SEQ ID NO: 1241 - protein, 365 aa, Escherichia coli
MKKLTVAISAVAASVLMAMSAQAAEIYNKDSNKLDLYGKVNAKHYFSSNDADDGDTTYARLGFKGETQINDQLTGFGQWEYEFKGNRAESQGSSKDKTRLAFAGLKFGDYGSIDYGRNYGVAYDIGAWTDVLPEFGGDTWTQTDVFMTQRATGVATYRNNDFFGLVDGLNFAAQYQGKNDRSDFDNYTEGNGDGFGFSATYEYEGFGIGATYAKSDRTDTQVNAGKVLPEVFASGKNAEVWAAGLKYDANNIYLATTYSETQNMTVFADHFVANKAQNFEAVAQYQFDFGLRPSVAYLQSKGKDLGVWGDQDLVKYVDVGATYYFNKNMSTFVDYKINLLDKNDFTKALGVSTDDIVAVGLVYQF

SEQ ID NO: 1242 - protein, 359 aa, Escherichia coli
MNELVQILKNTRQHLMTGVSHMIPFVVSGGILLAVSVMLYGKGAVPDAVADPNLKKLFDIGVAGLTLMVPFLAAYIGYSIAERSALAPCAIGAWVGNSFGAGFFGALIAGIIGGIVVHYLKKIPVHKVLRSVMPIFIIPIVGTLITAGIMMWGLGEPVGALTNSLTQWLQGMQQGSIVMLAVIMGLMLAFDMGGPVNKVAYAFMLICVAQGVYTVVAIAAVGICIPPLGMGLATLIGRKNFSAEERETGKAALVMGCVGVTEGAIPFAAADPLRVIPSIMVGSVCGAVTAALVGAQCYAGWGGLIVLPVVEGKLGYIAAVAVGAVVTAVCVNVLKSLARKNGSSTDEKEDDLDLDFEIN

SEQ ID NO: 1243 - protein, 161 aa, Escherichia coli
MFSNHADMMLTQIAIGLCFTLLYFVVFRTLILQFNMCTPGREDAEVKLYSKAEYKASRGQTTAAEPKKELDQAAGILQALGGVGNISSINNCATRLRIALHDMSQTLDDEVFKKLGAHGVFRSGDAIQVIIGLHVSQLREQLDSLINSHQSAENVAITEAV

SEQ ID NO: 1244 - protein, 485 aa, Escherichia coli
MNTSHVRVVTHMCGFLVWLYSLSMLPPMVVALFYKEKSLFVFFITFVIFFCIGGGAWYTTKKSGIQLRTRDGFIIIVMFWILFSVISAFPLWIDSELNLTFIDALFEGVSGITTTGATVIDDVSSLPRAYLYYRSQLNFIGGLGVIVLAVAVLPLLGIGGAKLYQSEMPGPFKDDKLTPRLADTSRTLWITYSLLGIACIVCYRLAGMPLFDAICHGISTVSLGGFSTHSESIGYFNNYLVELVAGSFSLLSAFNFTLWYIVISRKTIKPLIRDIELRFFLLIALGVIIVTSFQVWHIGMYDLHGSFIHSFFLASSMLTDNGLATQDYASWPTHTIVFLLLSSFFGGCIGSTCGGIKSLRFLILFKQSKHEINQLSHPRALLSVNVGGKIVTDRVMRSVWSFFFLYTLFTVFFILVLNGMGYDFLTSFATVAACINNMGLGFGATASSFGVLNDIAKCLMCIAMILGRLEIYPVIILFSGFFWRS

SEQ ID NO: 1245 - protein, 145 aa, Escherichia coli
MRATDKQRGFTLLEIMVVIVIIGVLASLVVPNLMGNKEKADKQKAVSDIVALENALDMYKLDNHHYPTTNQGLESLVEAPTLPPLAANYNKEGYIKRLPADPWGNDYVLVNPGEHGAYDLLSAGPDGEMGTEDDITNWGLSKKKK

SEQ ID NO: 1246 - protein, 431 aa, Escherichia coli
MLERLSWKRLVLELLLCCLPAFILGAFFGYLPWFLLASVTGLLIWHFWNLLRLSWWLWVDRSMTPPPGRGSWEPLLYGLHQMQLRNKKRRRELGNLIKRFRSGAESLPDAVVLTTEEGGIFWCNGLAQQILGLRWPEDNGQNILNLLRYPEFTQYLKTRDFSRPLNLVLNTGRHLEIRVMPYTHKQLLMVARDVTQMHQLEGARRNFFANVSHELRTPLTVLQGYLEMMNEQPLEGAVREKALHTMREQTQRMEGLVKQLLTLSKIEAAPTHLLNEKVDVPMMLRVVEREAQTLSQKKQTFTFEIDNGLKVSGNEDQLRSAISNLVYNAVNHTPEGTHITVRWQRVPHGAEFSVEDNGPGIAPEHIPRLTERFYRVDKARSRQTGGSGLGLAIVKHAVNHHESRLNIESTVGKGTRFSFVIPERLIAKNSD

SEQ ID NO: 1247 - protein, 85 aa, Escherichia coli
MFQQEVTITAPNGLHTRPAAQFVKEAKGFTSEITVTSNGKSASAKSLFKLQTLGLTQGTVVTISAEGEDEQKAVEHLVKLMAELE

SEQ ID NO: 1248 - protein, 133 aa, Escherichia coli
MEISLLQAFALGIIAFIAGLDMFNGLTHMHRPVVLGPLVGLVLGDLHTGILTGGTLELVWMGLAPLAGAQPPNVIIGTIVGTAFAITTGVKPDVAVGVAVPFAVAVQMGITFLFSVMSGVMSRCDLATNPRRI

SEQ ID NO: 1249 - protein, 429 aa, Escherichia coli
MKKQRNLRSMAAQAVEQVVEQGQSLSNILPPLQQKVSDKDKALLQELCFGVLRTLSQLDWLINKLMARPMTGKQRTVHYLIMVGLYQLLYTRIPPHAALAETVEGAIAIKRPQLKGLINGVLRQFQRQQEELLAEFNASDARYLHPSWLLKRLQKAYPEQWQSIVEANNQRPPMWLRINRTHHSRDSWLALLDEAGMKGFPHADYPDAVRLETPAPVHALPGFEDGWVTVQDASAQGCMTWLAPQNGEHILDLCAAPGGKTTHILEVAPEAQVVAVDIDEQRLSRVYDNLKRLGMKATVKQGDGRYPSQWCGEQQFDRILLDAPCSATGVIRRHPDIKWLRRDRDIPELAQLQSEILDAIWPHLKTGGTLVYATCSVLPEENSLQIKAFLQRTADAELCETGTPEQPGKQNLPGAEEGDGFFYAKLIKK

SEQ ID NO: 1250 - protein, 390 aa, Escherichia coli
MRKLWNALRRPSARWSVLALVAIGIVIGIALIVLPHVGIKVTSTTEFCVSCHSMQPVYEEYKQSVHFQNASGVRAECHDCHIPPDIPGMVKRKLEASNDIYQTFIAHSIDTPEKFEAKRAELAEREWARMKENNSATCRSCHNYDAMDHAKQHPEAARQMKVAAKDNQSCIDCHKGIAHQLPDMSSGFRKQFDELRASANDSGDTLYSIDIKPIYAAKGDKEASGSLLPASEVKVLKRDGDWLQIEITGWTESAGRQRVLTQFPGKRIFVASIRGDVQQQVKTLEKTTVADTNTEWSKLQATAWMKKGDMVNDIKPIWAYADSLYNGTCNQCHGAPEIAHFDANGWIGTLNGMIGFTSLDKREERTLLKYLQMNASDTAGKAHGDKKEEK

SEQ ID NO: 1251 - protein, 442 aa, Escherichia coli
MAMFGFPHWQLKSTSTESGVVAPDERLPFAQTAVMGVQHAVAMFGATVLMPILMGLDPNLSILMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKSVSASAFDSWMAVMTVLCIGLVAVFTRGMIQRLLILVGLIVACLLYGVMTNVLGLGKAVDFTLVSHAAWFGLPHFSTPAFNGQAMMLIAPVAVILVAENLGHLKAVAGMTGRNMDPYMGRAFVGDGLATMLSGSVGGSGVTTYAENIGVMAVTKVYSTLVFVAAAVIAMLLGFSPKFGALIHTIPAAVIGGASIVVFGLIAVAGARIWVQNRVDLSQNGNLIMVAVTLVLGAGDFALTLGGFTLGGIGTATFGAILLNALLSRKLVDVPPPEVVHQEP

SEQ ID NO: 1252 - protein, 171 aa, Escherichia coli
MFDIGFSELLLVFIIGLVVLGPQRLPVAVKTVAGWIRALRSLATTVQNELTQELKLQEFQDSLKKVEKASLTNLTPELKASMDELRQAAESMKRSYVANDPEKASDEAHTIHNPVVKDNEAAHEGVTPAAAQTQASSPEQKPETTPEPVVKPAADAEPKTAAPSPSSSDKP

SEQ ID NO: 1253 - protein, 346 aa, Escherichia coli
MKVMRTTVATVVAATLSMSAFSVFAEASLTGAGATFPAPVYAKWADTYQKETGNKVNYQGIGSSGGVKQIIANTVDFGASDAPLSDEKLAQEGLFQFPTVIGGVVLAVNIPGLKSGELVLDGKTLGDIYLGKIKKWDDEAIAKLNPGLKLPSQNIAVVRRADGSGTSFVFTSYLAKVNEEWKNNVGTGSTVKWPIGLGGKGNDGIAAFVQRLPGAIGYVEYAYAKQNNLAYTKLISADGKPVSPTEENFANAAKGADWSKTFAQDLTNQKGEDAWPITSTTFILIHKDQKKPEQGTEVLKFFDWAYKTGAKQANDLDYASLPDSVVEQVRAAWKTNIKDSSGKPLY

SEQ ID NO: 1254 - protein, 282 aa, Escherichia coli
MAHQLKLLKDDFFASDQQAVAVADRYPQDVFAEHTHDFCELVIVWRGNGLHVLNDRPYRITRGDLFYIHADDKHSYASVNDLVLQNIIYCPERLKLNLDWQGAIPGFNASAGQPHWRLGSMGMAQARQVIGQLEHESSQHVPFANEMAELLFGQLVMLLNRHRYTSDSLPPTSSETLLDKLITRLAASLKSPFALDKFCDEASCSERVLRQQFRQQTGMTINQYLRQVRVCHAQYLLQHSRLLISDISTECGFEDSNYFSVVFTRETGMTPSQWRHLNSQKD

SEQ ID NO: 1255 - protein, 319 aa, Escherichia coli [sequence omitted]

SEQ ID NO: 1256 - protein, 477 aa, Escherichia coli
MFKNAFANLQKVGKSLMLPVSVLPIAGILLGVGSANFSWLPAVVSHVMAEAGGSVFANMPLIFAIGVALGFTNNDGVSALAAVVAYGIMVKTMAVVAPLVLHLPAEEIASKHLADTGVLGGIISGAIAAYMFNRFYRIKLPEYLGFFAGKRFVPIISGLAAIFTGVVLSFIWPPIGSAIQTFSQWAAYQNPVVAFGIYGFIERCLVPFGLHHIWNVPFQMQIGEYTNAAGQVFHGDIPRYMAGDPTAGKLSGGFLFKMYGLPAAAIAIWHSAKPENRAKVGGIMISAALTSFLTGITEPIEFSFMFVAPILYIIHAILAGLAFPICILLGMRDGTSFSHGLIDFIVLSGNSSKLWLFPIVGIGYAIVYYTIFRVLIKALDLKTPGREDATEDAKATGTSEMAPALVAAFGGKENITNLDACITRLRVSVADVSKVDQAGLKKLGAAGVVVAGSGVQAIFGTKSDNLKTEMDEYIRNH

SEQ ID NO: 1257 - protein, 258 aa, Escherichia coli
MSVEDTQPLITHLIELRKRLLNCIIAVIVIFLCLVYFANDIYHLVSAPLIKQLPQGSTMIATDVASPFFTPIKLTFMVSLILSAPVILYQVWAFIAPALYKHERRLVVPLLVSSSLLFYIGMAFAYFVVFPLAFGFLANTAPEGVQVSTDIASYLSFVMALFMAFGVSFEVPVAIVLLCWMGITSPEDLRKKRPYVLVGAFVVGMLLTPPDVFSQTLLAIPMYCLFEIGVFFSRFYVGKGRNREEENDAEAESEKTEE

SEQ ID NO: 1258 - protein, 143 aa, Escherichia coli
MINDIKWVQAQRKATDWRQAVEIATRPLVAYGAAQPCYVNGIIENTLNWGPYYLIAPGIALPHARPEQGANYNQVSITTLRTPVAFGNEECDPVWLLLCVSATDANAHILTIQRISQFIDSPQRLTAVGNASTDDALFALVSG

SEQ ID NO: 1259 - protein, 485 aa, Escherichia coli
MTITPQNLIALLPLLIVGLTVVVVMLSIAWRRNHFLNATLSVIGLNAALVSLWFVGQAGAMDVTPLMRVDGFAMLYTGLVLLASLATCTFAYPWLEGYNDNKDEFYLLVLIAALGGILLANANHLASLFLGIELISLPLFGLVGYAFRQKRSLEASIKYTILSAAASSFLLFGMALVYAQSGDLSFVALGKNLGDGMLNEPLLLAGFGLMIVGLGFKLSLVPFHLWTPDVYQGAPAPVSTFLATASKIAIFGVVMRLFLYAPVGDSEAIRVVLAIIAFASIIFGNLMALSQTNIKRLLGYSSISHLGYLLVALIALQTGEMSMEAVGVYLAGYLFSSLGAFGVVSLMSSPYRGPDADSLFSYRGLFWHRPILAAVMTVMMLSLAGIPMTLGFIGKFYVLAVGVQAHLWWLVGAVVVGSAIGLYYYLRVAVSLYLHAPEQPGRDAPSNWQYSAGGIVVLISALLVLVLGVWPQPLISIVRLAMPLM

SEQ ID NO: 1260 - protein, 327 aa, Escherichia coli
MLKKCLPLLLLCTAPVFAKPVLTVYTYDSFAADWGPGPVVKKAFEADCNCELKLVALEDGVSLLNRLRMEGKNSKADVVLGLDNNLLDAASKTGLFAKSGVAADAVNVPGGWNNDTFVPFDYGYFAFVYDKNKLKNPPQSLKELVESDQNWRVIYQDPRTSTPGLGLLLWMQKVYGDDAPQAWQKLAKKTVTVTKGWSEAYGLFLKGESDLVLSYTTSPAYHILEEKKDNYAAANFSEGHYLQVEVAARTAASKQPELAQKFLQFMVSPAFQNAIPTGNWMYPVANVTLPAGFEKLTKPATTLEFTPAEVAAQRQAWISEWQRAVSR

SEQ ID NO: 1261 - protein, 648 aa, Escherichia coli
MTPLLELKDIRRSYPAGDEQVEVLKGISLDIYAGEMVAIVGASGSGKSTLMNILGCLDKATSGTYRVAGQDVATLDADALAQLRREHFGFIFQRYHLLSHLTAEQNVEVPAVYAGLERKQRLLRAQELLQRLGLEDRTEYYPAQLSGGQQQRVSIARALMNGGQVILADEPTGALDSHSGEEVMAILHQLRDRGHTVIIVTHDPQVAAQAERVIEIRDGEIVRNPPAIEKVNVTGGTEPVVNTVSGWRQFVSGFNEALTMAWRALAANKMRTLLTMLGIIIGIASVVSIVVVGDAAKQMVLADIRSIGTNTIDVYPGKDFGDDDPQYQQALKYDDLIAIQKQPWVASATPAVSQNLRLRYNNVDVAASANGVSGDYFNVYGMTFSEGNTFNQEQLNGRAQVVVLDSNTRRQLFPHKADVVGEVILVGNMPARVIGVAEEKQSMFGSSKVLRVWLPYSTMSGRVMGQSWLNSITVRVKEGFDSAEAEQQLTRLLSLRHGKKDFFTWNMDGVLKTVEKTTRTLQLFLTLVAVISLVVGGIGVMNIMLVSVTERTREIGIRMAVGARASDVLQQFLIEAVLVCLVGGALGITLSLLIAFTLQLFLPGWEIGFSPLALLLAFLCSTVTGILFGWLPARNAARLDPVDALARE

SEQ ID NO: 1262 - protein, 351 aa, Escherichia coli
MKKSTLALVVMGIVASASVQAAEIYNKDGNKLDVYGKVKAMHYMSDNASKDGDQSYIRFGFKGETQINDQLTGYGRWEAEFAGNKAESDTAQQKTRLAFAGLKYKDLGSFDYGRNLGALYDVEAWTDMFPEFGGDSSAQTDNFMTKRASGLATYRNTDFFGVIDGLNLTLQYQGKNENRDVKKQNGDGFGTSLTYDFGGSDFAISGAYTNSDRTNEQNLQSRGTGKRAEAWATGLKYDANNIYLATFYSETRKMTPITGGFANKTQNFEAVAQYQFDFGLRPSLGYVLSKGKDIEGIGDEDLVNYIDVGATYYFNKNMSAFVDYKINQLDSDNKLNINNDDIVAVGMTYQF

SEQ ID NO: 1263 - protein, 87 aa, Escherichia coli
MKPNIHPEYRTVVFHDTSVDEYFKIGSTIKTDREIELDGVTYPYVTIDVSSKSHPFYTGKLRTVASEGNVARFTQRFGRFVSTKKGA

SEQ ID NO: 1264 - protein, 67 aa, Escherichia coli
MGEISITKLLVVAALVVLLFGTKKLRTLGGDLGAAIKGFKKAMNDDDAAAKKGADVDLQAEKLSHKE

SEQ ID NO: 1265 - protein, 348 aa, Escherichia coli
MKKWSRHLLAAGALALGMSAAHADDNNTLYFYNWTEYVPPGLLEQFTKETGIKVIYSTYESNETMYAKLKTYKDGAYDLVVPSTYYVDKMRKEGMIQKIDKSKLTNFSNLDPDMLNKPFDPNNDYSIPYIWGATAIGVNGDAVDPKSVTSWADLWKPEYKGSLLLTDDAREVFQMALRKLGYSGNTTDPKEIEAAYNELKKLMPNVAAFNSDNPANPYMEGEVNLGMIWNGSAFVARQAGTPIDVVWPKEGGIFWMDSLAIPANAKNKEGALKLINFLLRPDVAKQVAETIGYPTPNLAARKLLSPEVANDKTLYPDAETIKNGEWQNDVGAASSIYEEYYQKLKAGR

SEQ ID NO: 1266 - protein, 342 aa, Escherichia coli
MRVLLFLLLSLFMLPAFSADNLLRWHDAQHFTVQASTPLKAKRAWKLCALYPSLKDSYWLSLNYGMQEAARRYGVDLKVLEAGGYSQLATQQAQIDQCKQWGAEAILLGSSTTSFPDLQKQVASLPVIELVNAIDAPQVKSRVGVPWFQMGYQPGRYLVQWAHGKPLNVLLMPGPDNAGGSKEMVEGFRAAIAGSPVRIVDIALGDNDIEIQRNLLQEMLERHPEIDVVAGTAIAAEAAMGEGRNLKTPLTVVSFYLSHQVYRGLKRGRVIMAASDQMVWQGELAVEQAIRQLQGQSVSDNVSPPILVLTPKNADREHIRRSLSPGGFRPVYFYQHTSAAKK

SEQ ID NO: 1267 - protein, 235 aa, Escherichia coli
MQQKSDNVVSHYVFEAPVRIWHWLTVLCMAVLMVTGYFIGKPLPSVSGEATYLFYMGYIRLIHFSAGMVFTVVLLMRIYWAFVGNRYSRELFIVPVWRKSWWQGVWYEIRWYLFLAKRPSADIGHNPIAQAAMFGYFLMSVFMIITGFALYSEHSQYAIFAPFRYVVEFFYWTGGNSMDIHSWHRLGMWLIGAFVIGHVYMALREDIMSDDTVISTMVNGYRSHKFGKISNKERS

SEQ ID NO: 1268 - protein, 384 aa, Escherichia coli
MLLVLVLIGLNMRPLLTSVGPLLPQLRQASGMSFSVAALLTALPVVTMGGLALAGSWLHQHVSERRSVAISLLLIAVGALMRELYPQSALLLSSALLGGVGIGIIQAVMPSVIKRRFQQRTPLVMGLWSAALMGGGGLGAAITPWLVQHSETWYQTLAWWALPAVVALFAWWWQSAREVASSHKTTTTPVRVVFTPRAWTLGVYFGLINGGYASLIAWLPAFYIEIGASAQYSGSLLALMTLGQAAGALLMPAMARHQDRRKLLMLALVLQLVGFCGFIWLPMQLPVLWAMVCGLGLGGAFPLCLLLALDHSVQPAIAGKLVAFMQGIGFIIAGLAPWFSGVLRSISGNYLMDWAFHALCVVGLMIITLRFAPVRFPQLWVKEA

SEQ ID NO: 1269 - protein, 457 aa, Escherichia coli
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRASR

SEQ ID NO: 1270 - protein, 241 aa, Escherichia coli
MATLTAKNLAKAYKGRRVVEDVSLTVNSGEIVGLLGPNGAGKTTTFYMVVGIVPRDAGNIIIDDDDISLLPLHARARRGIGYLPQEASIFRRLSVYDNLMAVLQIRDDLSAEQREDRANELMEEFHIEHLRDSMGQSLSGGERRRVEIARALAANPKFILLDEPFAGVDPISVIDIKRIIEHLRDSGLGVLITDHNVRETLAVCERAYIVSQGHLIAHGTPTEILQDEHVKRVYLGEDFRL

SEQ ID NO: 1271 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 1272 - protein, 269 aa, Escherichia coli
MSNTDASGEKRVTGTSERREQIIQRLRQQGSVQVNDLSALYGVSTVTIRNDLAFLEKQGIAVRAYGGALICDSTTPSVEPSVEDKSALNTAMKRSVAKAAVELIQPGHRVILDSGTTTFEIARLMRKHTDVIAMTNGMNVANALLEAEGVELLMTGGHLRRQSQSFYGDQAEQSLQNYHFDMLFLGVDAIDLERGVSTHNEDEARLNRRMCEVAERIIVVTDSSKFNRSSLHKIIDTQRIDMIIVDEGIPADSLEGLRKAGVEVILVGE

SEQ ID NO: 1273 - protein, 417 aa, Escherichia coli
MSHWATFKQTATNLWVTLRHDILALAVFLNGLLIFKTIYGMSVNLLDIFHIKAFSELDLSLLANAPLFMLGVFLVLNSIGLLFRAKLAWAISIILLLIALIYTLHFYPWLKFSIGFCIFTLVFLLILRKDFSHSSAAAGTIFAFISFTTLLFYSTYGALYLSEGFNPRIESLMTAFYFSIETMSTVGYGDIVPVSESARLFTISVIISGITVFATSMTSIFGPLIRGGFNKLVKGNNHTMHRKDHFIVCGHSILAINTILQLNQRGQNVTVISNLPEDDIKQLEQRLGDNADVIPGDSNDSSVLKKAGIDRCRAILALSDNDADNAFVVLSAKDMSSDVKTVLAVSDSKNLNKIKMVHPDIILSPQLFGSEILARVLNGEEINNDMLVSMLLNSGHGIFSDNDELETKADSKESAQK

SEQ ID NO: 1274 - protein, 147 aa, Escherichia coli
MSMSTSTEVIAHHWAFAIFLIVAIGLCCLMLVGGWFLGGRARARSKNVPFESGIDSVGSARLRLSAKFYLVAMFFVIFDVEALYLFAWSTSIRESGWVGFVEAAIFIFVLLAGLVYLVRIGALDWTPARSRRERMNPETNSIANRQR

SEQ ID NO: 1275 - protein, 658 aa, Escherichia coli
MVLFYRAHWRDYKNDQVRIMMNLTTLTHRDALCLNARFTSREEAIHALTQRLAALGKISSTEQFLEEVYRRESLGPTALGEGLAVPHGKTAAVKEAAFAVATLSEPLQWEGVDGPEAVDLVVLLAIPPNEAGTTHMQLLTALTTRLADDEIRARIQSATTPDELLSALDDKGGTQPSASFSNAPTIVCVTACPAGIAHTYMAAEYLEKAGRKLGVNVYVEKQGANGIEGRLTADQLNSATACIFAAEVAIKESERFNGIPALSVPVAEPIRHAEALIQQALTLKRSDETRTVQQDTQPVKSVKTELKQALLSGISFAVPLIVAGGTVLAVAVLLSQIFGLQDLFNEENSWLWMYRKLGGGLLGILMVPVLAAYTAYSLADKPALAPGFAAGLAANMIGSGFLGAVVGGLIAGYLMRWVKNHLRLSSKFNGFLTFYLYPVLGTLGAGSLMLFVVGEPVAWINNSLTAWLNGLSGSNALLLGAILGFMCSFDLGGPVNKAAYAFCLGAMANGVYGPYAIFASVKMVSAFTVTASTMLAPRLFKEFEIETGKSTWLLGLAGITEGAIPMAIEDPLRVIGSFVLGSMVTGAIVGAMNIGLSTPGAGIFSLFLLHDNGAGGVMAAIGWFGAALVGAAISTAILLMWRRHAVKHGNYLTDGVMP

SEQ ID NO: 1276 - protein, 400 aa, Escherichia coli
MASKQLWRWHGITGDGNAQDGMLWAESRTLLLMALQQQMVTPLSLKRIAINSAQWRGDKSAEVIHQLATLLKAGLTLSEGLALLAEQHPSKQWQALLQSLAHDLEQGIAFSNALLPWSEVFPPLYQAMIRTGELTGKLDECCFELARQQKAQRQLTDKVKSALRYPIIILAMAIMVVVAMLHFVLPEFAAIYKTFNTPLPALTQGIMTLADFSGEWSWLLVLFGFLLAIANKLLMRRPTWLIVRQKLLLRIPIMGSLMRGQKLTQIFTILALTQSAGITFLQGVESVRETMRCPYWVQLLTQIQHDISNGQPIWLALKNTGEFSPLCLQLVRTGEASGSLDLMLDNLAHHHRENTMALADNLAALLEPALLIITGGIIGTLVVAMYLPIFHLGDAMSGMG

SEQ ID NO: 1277 - protein, 150 aa, Escherichia coli
MHADTATRQHWMSVLAHSQPAELAARLNALNITADYEVIRAAETGLVQIQARMGGTGERFFAGDATLTRAAVRLTDGTLGYSWVQGRDKQHAERCALIDALMQQSRHFQNLSETLIAPLDADRMARIAARQAEVNASRVDFFTMVRGDNA

SEQ ID NO: 1278 - protein, 483 aa, Escherichia coli
MQLEVILPLVAYLVVVFGISVYAMRKRSTGTFLNEYFLGSRSMGGIVLAMTLTATYISASSFIGGPGAAYKYGLGWVLLAMIQLPAVWLSLGILGKKFAILARRYNAVTLNDMLFARYQSRLLVWLASLSLLVAFVGAMTVQFIGGARLLETAAGIPYETGLLIFGISIALYTAFGGFRASVLNDTMQGLVMLIGTVVLLIGVVHAAGGLSNAVQTLQTIDPQLVTPQGADDILSPAFMTSFWVLVCFGVIGLPHTAVRCISYKDSKAVHRGIIIGTIVVAILMFGMHLAGALGRAVIPDLTVPDLVIPTLMVKVLPPFAAGIFLAAPMAAIMSTINAQLLQSSATIIKDLYLNIRPDQMQNETRLKRMSAVITLVLGALLLLAAWKPPEMIIWLNLLAFGGLEAVFLWPLVLGLYWERANAKGALSAMIVGGVLYAVLATLNIQYLGFHPIVPSLLLSLLAFLVGNRFGTSVPQATVLTTDK

SEQ ID NO: 1279 - protein, 262 aa, Escherichia coli
MQTIIRVEKLAKTFNQHQALHAVDLNIHHGEMVALLGPSGSGKSTLLRHLSGLITGDKSVGSHIELLGRTVQREGRLARDIRKSRAHTGYIFQQFNLVNRLSVLENVLIGALGSTPFWRTCFSWFTGEQKQRALQALTRVGMVHFAHQRVSTLSGGQQQRVAIARALMQQAKVILADEPIASLDPESARIVMDTLRDINQNDGITVVVTLHQVDYALRYCERIVALRQGHVFYDGSSQQFDNERFDHLYRSINRVEENAKAA

SEQ ID NO: 1280 - protein, 1107 aa, Escherichia coli
MRLIITFLMAWCLSWGAYAATAPDSKQITQELEQAKAAKPAQPEVVEALQSALNALEERKGSLERIKQYQQVIDNYPKLSATLRAQLNNMRDEPRSVSPGMSTDALNQEILQVSSQLLDKSRQAQQEQERAREIADSLNQLPQQQTDARRQLNEIERRLGTLTGNTPLNQAQNFALQSDSARLKALVDELELAQLSANNRQELARLRSELAEKESQQLDAYLQALRNQLNSQRQLEAERALESTELLAENSADLPKDIVAQFKINRELSAALNQQAQRMDLVASQQRQAASQTLQVRQALNTLREQSQWLGSSNLLGEALRAQVARLPEMPKPQQLDTEMAQLRVQRLRYEDLLNKQPLLRQIHQADGQPLTAEQNRILEAQLRTQRELLNSLLQGGDTLLLELTKLKVSNGQLEDALKEVNEATHRYLFWTSDVRPMTIAWPLEIAQDLRRLISLDTFSQLGKASVMMLTSKETILPLFGALILVGCSIYSRRYFTRFLERSAAKVGKVTQDHFWLTLRTLFWSILVASPLPVLWMTLGYGLREAWPYPLAVAIGDGVTATVPLLWVVMICATFARPNGLFIAHFGWPRERVSRGMRYYLMSIGLIVPLIMALMMFDNLDDREFSGSLGRLCFILICGALAVVTLSLKKAGIPLYLNKEGSGDNITNHMLWNMMIGAPLVAILASAVGYLATAQALLARLETSVAIWFLLLVVYHVIRRWMLIQRRRLAFDRAKHRRAEMLAQRARGEEEAHHHSSPEGAIEVDESEVDLDAISAQSLRLVRSILMLIALLSVIVLWSEIHSAFGFLENISLWDVTSTVQGVESLEPITLGAVLIAILVFIITTQLVRNLPALLELAILQHLDLTPGTGYAITTITKYLLMLIGGLVGFSMIGIEWSKLQWLVAALGVGLGFGLQEIFANFISGLIILFEKPIRIGDTVTIRDLTGSVTKINTRATTISDWDRKEIIVPNKAFITEQFINWSLSDSVTRVVLTIPAPADANSEEVTEILLTAARRCSLVIDNPAPEVFLVDLQQGIQIFELRIYAAEMGHRMPLRHEIHQLILAGFHAHGIDMPFPPFQMRLESLNGKQTGRTLTSAGKGRQAGSL

SEQ ID NO: 1281 - protein, 252 aa, Escherichia coli
MNQPLLSVNNLTHLYAPGKGFSDVSFDLWPGEVLGIVGESGSGKTTLLKSISARLTPQQGEIHYENRSLYAMSEADRRRLLRTEWGVVHQHPLDGLRRQVSAGGNIGERLMATGARHYGDIRATAQKWLEEVEIPANRIDDLPTTFSGGMQQRLQIARNLVTHPKLVFMDEPTGGLDVSVQARLLDLLRGLVVELNLAVVIVTHDLGVARLLADRLLVMKQGQVVESGLTDRVLDDPHHPYTQLLVSSVLQN

SEQ ID NO: 1282 - protein, 403 aa, Escherichia coli
MSTRTPSSSSSRLMLTIGLCFLVALMEGLDLQAAGIAAGGIAQAFALDKMQMGWIFSAGILGLLPGALVGGMLADRYGRKRILIGSVALFGLFSLATAIAWDFPSLVFARLMTGVGLGAALPNLIALTSEAAGPRFRGTAVSLMYCGVPIGAALAATLGFAGANLAWQTVFWVGGVVPLILVPLLMRWLPESAVFAGEKQSAPPLRALFAPETATATLLLWLCYFFTLLVVYMLINWLPLLLVEQGFQPSQAAGVMFALQMGAASGTLMLGALMDKLRPVTMSLLIYSGMLASLLALGTVSSFNGMLLAGFVAGLFATGGQSVLYALAPLFYSSQIRATGVGTAVAVGRLGAMSGPLLAGKMLALGTGTVGVMAASAPGILVAGLAVFILMSRRSRIQPCADA

SEQ ID NO: 1283 - protein, 121 aa, Escherichia coli
MYIYWILLGLAIATEITGTLSMKWASVSEGNGGFILMLVMISLSYIFLSFAVKKIALGVAYALWEGIGILFITLFSVLLFDESLSLMKIAGLTTLVAGIVLIKSGTRKARKPELEVNHGAV

SEQ ID NO: 1284 - protein, 551 aa, Escherichia coli
MNLWQQNYDPAGNIWLSSLIASLPILFFFFALIKLKLKGYVAASWTVAIALAVALLFYKMPVANALASVVYGFFYGLWPIAWIIIAAVFVYKISVKTGQFDIIRSSILSITPDQRLQMLIVGFCFGAFLEGAAGFGAPVAITAALLVGLGFKPLYAAGLCLIVNTAPVAFGAMGIPILVAGQVTGIDSFEIGQMVGRQLPFMTIIVLFWIMAIMDGWRGIKETWPAVVVAGGSFAIAQYLSSNFIGPELPDIISSLVSLLCLTLFLKRWQPVRVFRFGDLGASQVDMTLAHTGYTAGQVLRAWTPFLFLTATVTLWSIPPFKALFASGGALYEWVINIPVPYLDKLVARMPPVVSEATAYAAVFKFDWFSATGTAILFAALLSIVWLKMKPSDAISTFGSTLKELALPIYSIGMVLAFAFISNYSGLSSTLALALAHTGHAFTFFSPFLGWLGVFLTGSDTSSNALFAALQATAAQQIGVSDLLLVAANTTGGVTGKMISPQSIAIACAAVGLVGKESDLFRFTVKHSLIFTCIVGVITTLQAYVLTWMIP

SEQ ID NO: 1285 - protein, 493 aa, Escherichia coli
MNKHASQPRAIYYVVALQIWEYFSFYGMRALLILYLTNQLKYNDTHAYELFSAYCSLVYVTPILGGFLADKVLGNRMAVMLGALLMAIGHVVLGASEIHPSFLYLSLAIIVCGYGLFKSNVSCLLGELYEPTDPRRDGGFSLMYAAGNVGSIIAPIACGYAQEEYSWAMGFGLAAVGMIAGLVIFLCGNRHFTHTRGVNKKVLRATNFLLPNWGWLLVLLVATPALITILFWKEWSVYALIVATIIGLGVLAKIYRKAENQKQRKELGLIVTLTFFSMLFWAFAQQGGSSISLYIDRFVNRDMFGYTVPTAMFQSINAFAVMLCGVFLAWVVKESVAGNRTVRIWGKFALGLGLMSAGFCILTLSARWSAMYGHSSLPLMVLGLAVMGFAELFIDPVAMSQITRIEIPGVTGVLTGIYMLLSGAIANYLAGVIADQTSQASFDASGAINYSINAYIEVFDQITWGALACVGLVLMIWLYQALKFRNRALALES

SEQ ID NO: 1286 - protein, 438 aa, Escherichia coli
MPLVIVAIGVILLLLLMIRFKMNGFIALVLVALAVGLMQGMPLDKVIGSIKAGVGGTLGSLALIMGFGAMLGKMLADCGGAQRIATTLIAKFGKKHIQWAVVLTGFTVGFALFYEVGFVLMLPLVFTIAASANIPLLYVGVPMAAALSVTHGFLPPHPGPTAIATIFNADMGKTLLYGTILAIPTVILAGPVYARVLKGIDKPIPEGLYSAKTFSEEEMPSFGVSVWTSLVPVVLMAMRAIAEMILPKGHAFLPVAEFLGDPVMATLIAVLIAMFTFGLNRGRSMDQINDTLVSSIKIIAMMLLIIGGGGAFKQVLVDSGVDKYIASMMHETNISPLLMAWSIAAVLRIALGSATVAAITAGGIAAPLIATTGVSPELMVIAVGSGSVIFSHVNDPGFWLFKEYFNLTIGETIKSWSMLETIISVCGLVGCLLLNMVI

SEQ ID NO: 1287 - protein, 99 aa, Escherichia coli
MALTKAEMSEYLFDKLGLSKRDAKELVELFFEEIRRALENGEQVKLSGFGNFDLRDKNQRPGRNPKTGEDIPITARRVVTFRPGQKLKSRVENASPKDE

SEQ ID NO: 1288 - protein, 169 aa, Escherichia coli
MNQQRGFTLLEMMLVLALVAITASVVLFTYGREDVASTRARETAARFTAALELAIDRATLSGQPVGIHFSDSAWRIMVPGKTPSAWRWVPLQEDAADESQNDWDEELSIHLQPFKPDDSNQPQVVILADGQITPFSLLMANAGTGEPLLTLVCSGSWPLDQTLARDTRP

SEQ ID NO: 1289 - protein, 387 aa, Escherichia coli
MPESLMVIRSSSTLRKHWEWMTFSADSVSSVHTLTDDLPLESLADQPGAGNVHLLIPPEGLLYRSLTLPNAKYKLTAQTLQWLAEETLPDNTQDWHWTVVDKQNESVEVIGIQSEKLSRYLERLHTAGLNVTRVLPDGCYLPWEVDSWTLVNQQTSWLIRSAAHAFNELDEHWLQHLAAQFPPENMLCYGVVPHGVAAANPLIQHPEIPSLSLYSADIAFQRYDMLHGIFRKQKTVSKSGKWLARLAVSCLVLAILSFVGSRSIALWHTLKIEDQLQQQQQETWQRYFPQIKRTHNFRFYFKQQLAQQYPEAVPLLYHLQTLLLEHPELQLMEANYSQKQKSLTLKMSAKSEANIDRFCELTQSWLPMEKTEKDPVSGVWTVRNSGK

SEQ ID NO: 1290 - protein, 338 aa, Escherichia coli
MNAKIIASLAFTSMFSLSTLLSPAHAEEQEKALNFGIISTESQQNLKPQWTPFLQDMEKKLGVKVNAFFAPDYAGIIQGMRFNKVDIAWYGNLSAMEAVDRANGQVFAQTVAADGSPGYWSVLIVNKDSPINNLNDLLAKRKDLTFGNGDPNSTSGFLVPGYYVFAKNNISASDFKRTVNAGHETNALAVANKQVDVATNNTENLDKLKTSAPEKLKELKVIWKSPLIPGDPIVWRKNLSETTKDKIYDFFMNYGKTPEEKAVLERLGWAPFRASSDLQLVPIRQLALFKEMQGVKSNKGLNEQDKLAKTTEIQAQLDDLDRLNNALSAMSSVSKAVQ

SEQ ID NO: 1291 - protein, 122 aa, Escherichia coli
MLALFIHTTGVLSKLLSEAVEAIEPGPVEGIRATGANKLEEILYGVLPQVMPLLISYSLYRFESNVRSATVVGMVGAGGIGVTLWEAIRGFQFQQTCALMVLIIVTVSLLDFLSQRLRKHFI

SEQ ID NO: 1292 - protein, 445 aa, Escherichia coli [sequence omitted]

SEQ ID NO: 1293 - protein, 227 aa, Escherichia coli
MLTVPGLCWLCRMPLALGHWGICSVCSRATRTDKTLCPQCGLPATHSHLPCGRCLQKPPPWQRLVTVADYAPPLSPLIHQLKFSRRSEIASALSRLLLLEVLHARRTTGLQLPDRIVSVPLWQRRHWRRGFNQSDLLCQPLSRWLHCQWDSEAVTRTRATATQHFLSARLRKRNLKNAFRLELPVQGRHMVIVDDVVTTGSTVAEIAQLLLRNGAAAVQVWCLCRTL

SEQ ID NO: 1294 - protein, 475 aa, Escherichia coli
MSDKKKRSMAGLPWIAAMAFFMQALDATILNTALPAIAHSLNRSPLAMQSAIISYTLTVAMLIPVSGWLADRFGTRRIFTLAVSLFTLGSLACALSNSLPQLVVFRVIQGIGGAMMMPVARLALLRAYPRNELLPVLNFVAMPGLVGPILGPVLGGVLVTWATWHWIFLINIPIGIAGLLYARKHMPNFTTARRRFDITGFLLFGLSLVLFSSGIELFGEKIVASWIALTVIVTSIGLLLLYILHARRTPNPLISLDLFKTRTFSIGIVGNIATRLGTGCVPFLMPLMLQVGFGYQAFIAGCMMAPTALGSIIAKSMVTQVLRRLGYRHTLVGITVIIGLMIAQFSLQSPAMAIWMLILPLFILGMAMSTQFTAMNTITLADLTDDNASSGNSVLAVTQQLSISLGVAVSAAVLRVYEGMEGTTTVEQFHYTFITMGIITVASAAMFMLLKTTDGNNLIKRQRKSKPNRVPSESE

SEQ ID NO: 1295 - protein, 453 aa, Escherichia coli
MEKENITIDPRSSFTPSSSADIPVPPDGLVQRSTRIKRIQTTAMLLLFFAAVINYLDRSSLSVANLTIREELGLSATEIGALLSVFSLAYGIAQLPCGPLLDRKGPRLMLGLGMFFWSLFQAMSGMVHNFTQFVLVRIGMGIGEAPMNPCGVKVINDWFNIKERGRPMGFFNAASTIGVAVSPPILAAMMLVMGWRGMFITIGVLGIFLAIGWYMLYRNREHVELTAVEQAYLNAGSVNARRDPLSFAEWRSLFRNRTMWGMMLGFSGINYTAWLYLAWLPGYLQTAYNLDLKSTGLMAAIPFLFGAAGMLVNGYVTDWLVKGGMAPIKSRKICIIAGMFCSAAFTLIVPQATTSMTAVLLIGMALFCIHFAGTSCWGLIHVAVASRMTASVGSIQNFASFICASFAPIITGFIVDTTHSFRLALIICGCVTAAGALAYIFLVRQPINDPRKD

SEQ ID NO: 1296 - protein, 185 aa, Escherichia coli
MKFKTNKLSLNLVLASSLLAASIPAFAVTGDTDQPIHIESDQQSLDMQGNVVTFTGNVIVTQGTIKINADKVVVTRPGGEQGKEVIDGYGKPATFYQMQDNGKPVEGHASQMHYELAKDFVVLTGNAYLQQVDSNIKGDKITYLVKEQKMQAFSDKGKRVTTVLVPSQLQDKNNKGQTPAQKKGN

SEQ ID NO: 1297 - protein, 266 aa, Escherichia coli
MAKSLFRALVALSFLAPLWLNAAPRVITLSPANTELAFAAGITPVGVSSYSDYPPQAQKIEQVSTWQGMNLERIVALKPDLVIAWRGGNAERQVDQLASLGIKVMWVDATSIEQIANALRQLAPWSPQPDKAEQAAQSLLDQYAQLKAQYADKPKKRVFLQFGINPPFTSGKESIQNQVLEVCGGENIFKDSRVPWPQVSREQVLARSPQAIVITGGPDQIPKIKQYWGEQLKIPVIPLTSDWFERASPRIILAAQQLCNALSQVD

SEQ ID NO: 1298 - protein, 865 aa, Escherichia coli
MTIEYTKNYHHLTRIATFCALLYCNTAFSAELVEYDHTFLMGQNASNIDLSRYSEGNPAIPGVYDVSVYVNDQPIINQSITFVAIEGKKNAQACITLKNLLQFHINSPDINNEKAVLLARDETLGNCLNLTEIIPQASVRYDVNDQRLDIDVPQAWVMKNYQNYVDPSLWENGINAAMLSYNLNGYHSETPGRKNESIYAAFNGGMNLGAWRLRASGNYNWMTDSGSNYDFKNRYVQRDIASLRSQLILGESYTTGETFDSVSIRGIRLYSDSRMLPPTLASFAPIIHGVANTNAKVTITQGGYKIYETTVPPGAFVIDDLSPSGYGSDLIVTIEESDGSKRTFSQPFSSVVQMLRPGVGRWDISGGQVLKDDIQDEPNLFQASYYYGLNNYLTGYTGIQITDNNYTAGLLGLGLNTSVGAFSFDVTHSNVRIPDDKTYQGQSYRVSWNKLFEETSTSLNIAAYRYSTQNYLGLNDALTLIDEVKHPEQDLEPKSMRNYSRMKNQVTVSINQPLKFEKKDYGSFYLSGSWSDYWASGQNRSNYSIGYSNSTSWGSYSVSAQRSWNEDGDTDDSVYLSFTIPIEKLLGTEQRTSGFQSIDTQISSDFKGNNQLNVSSSGYSDNARVSYSVNTGYTMNKASKDLSYVGGYASYESPWGTLAGSISANSDNSRQVSLSTDGGFVLHSGGLTFSNDSFSDSDTLAVVQAPGAQGARINYGNSTIDRWGYGVTSALSPYHENRIALDINDLENDVELKSTSAVAVPRQGSVVFADFETVQGQSAIMNITRSDGKNIPFAADIYDEQGNVIGNVGQGGQAFVRGIEQQGNISIKWLEQSKPVSCLAHYQQSPEAEKIAQSIILNGIRCQIQ

SEQ ID NO: 1299 - protein, 593 aa, Escherichia coli
MRSFSQLWPTLKRLLAYGSPWRKPLGIAVLMMWVAAAAEVSGPLLISYFIDNMVAKNNLPLKVVAGLAAAYVGLQLFAAGLHYAQSLLFNRAAVGVVQQLRTDVMDAALRQPLSEFDTQPVGQVISRVTNDTEVIRDLYVTVVATVLRSAALVGAMLVAMFSLDWRMALVAIMIFPVVLVVMVIYQRYSTPIVRRVRAYLADINDGFNEIINGMSVIQQFRQQARFGERMGEASRSHYMARMQTLRLDGFLLRPLLSLFSSLILCGLLMLFGFSASGTIEVGVLYAFISYLGRLNEPLIELTTQQAMLQQAVVAGERVFELMDGPRQQYGNDDRPLQSGTIEVDNVSFAYRDDNLVLKNINLSVPSRNFVALVGHTGSGKSTLASLLMGYYPLTEGEIRLDGRPLSSLSHSALRQGVAMVQQDPVVLADTFLANVTLGRDISEERVWQALETVQLAELARSMSDGIYTPLGEQGNNLSVGQKQLLALARVLVETPQILILDEATASIDSGTEQAIQHALAAVREHTTLVVIAHRLSTIVDADTILVLHRGQAVEQGTHQQLLAAQGRYWQMYQLQLAGEELAASVREEESLSA

SEQ ID NO: 1300 - protein, 164 aa, Escherichia coli
MVDSKKRPGKDLDRIDRNILNELQKDGRISNVELSKRVGLSPTPCLERVRRLERQGFIQGYTALLNPHYLDASLLVFVEITLNRGAPDVFEQFNTAVQKLEEIQECHLVSGDFDYLLKTRVPDMSAYRKLLGETLLRLPGVNDTRTYVVMEEVKQSNRLVIKTR

SEQ ID NO: 1301 - protein, 237 aa, Escherichia coli [sequence omitted]

SEQ ID NO: 1302 - protein, 302 aa, Escherichia coli
MMLSKKNSETLENFSEKLEVEGRSLWQDARRRFMHNRAAVASLIVLVLIALFVILAPMLSQFAYDDTDWAMMSSAPDMESGHYFGTDSSGRDLLVRVAIGGRISLMVGVAAALVAVVVGTLYGSLSGYLGGKVDSVMMRLLEILNSFPFMFFVILLVTFFGQNILLIFVAIGMVSWLDMARIVRGQTLSLKRKEFIEAAQVGGVSTSGIVIRHIVPNVLGVVVVYASLLVPSMILFESFLSFLGLGTQEPLSSWGALLSDGANSMEVSPWLLLFPAGFLVVTLFCFNFIGDGLRDALDPKDR

SEQ ID NO: 1303 - protein, 332 aa, Escherichia coli
MTAIKHPVLLWGLPVAALIIIFWLSLFCYSAIPVSGADATRALLPGHTPTLPEALVQNLRLPRSLVAVLIGASLALAGTLLQTLTHNPMASPSLLGINSGAALAMALTSALSPTPIAGYSLSFIAACGGGVSWLLVMTAGGGFRHTHDRNKLILAGIALSAFCMGLTRITLLLAEDHAYGIFYWLAGGVSHARWQDVWQLLPVVVTAVPVVLLLANQLNLLNLSDSTAHTLGVNLTRLRLVINMLVLLLVGACVSVAGPVAFIGLLVPHLARFWAGFDQRNVLPVSMLLGATLMLLADVLARALAFPGDLPAGAVLALIGSPCFVWLVRRRG

SEQ ID NO: 1304 - protein, 729 aa, Escherichia coli
MLSTQFNRDNQYQAITKPSLLAGCIALALLPSAAFAAPATEETVIVEGSATAPDDGENDYSVTSTSAGTKMQMTQRDIPQSVTIVSQQRMEDQQLQTLGEVMENTLGISKSQADSDRALYYSRGFQIDNYMVDGIPTYFESRWNLGDALSDMALFERVEVVRGATGLMTGTGNPSAAINMVRKHATSREFKGDVSAEYGSWNKERYVADLQSPLTEDGKIRARIVGGYQNNDSWLDRYNSEKTFFSGIVDADLGDLTTLSAGYEYQRIDVNSPTWGGLPRWNTDGSSNSYDRARSTAPDWAYNDKEINKVFMTLKQQFADTWQATLNATHSEVEFDSKMMYVDAYVNKADGMLVGPYSNYGPGFDYVGGTGWNSGKRKVDALDLFADGSYELFGRQHNLMFGGSYSKQNNRYFSSWANIFPDEIGSFYNFNGNFPQTDWSPQSLAQDDTTHMKSLYAATRVTLADPLHLILGARYTNWRVDTLTYSMEKNHTTPYAGLVFDINDNWSTYASYTSIFQPQNDRDSSGKYLAPITGNNYELGLKSDWMNSRLTTTLAIFRIEQDNVAQSTGTPIPGSNGETAYKAVDGTVSKGVEFELNGAITDNWQLTFGATRYIAEDNEGNAVNPNLPRTTVKMFTSYRLPVMPELTVGGGVNWQNRVYTDTVTPYGTFRAEQGSYALVDLFTRYQVTKNFSLQGNVNNLFDKTYDTNVEGSIVYGTPRNFSITGTYQF

SEQ ID NO: 1305 - protein, 85 aa, Escherichia coli
MQTVIFGRSGCPYCVRAKDLAEKLSNERDDFQYQYVDIRAEGITKEDLQQKAGKPVETVPQIFVDQQHIGGYTDFAAWVKENLDA

SEQ ID NO: 1306 - protein, 78 aa, Escherichia coli
MASLIQVRDLLALRGRMEAAQISQTLNTPQPMINAMLQQLESMGKAVRIQEEPDGCLSGSCKSCPEGKACLREWWALR

SEQ ID NO: 1307 - protein, 367 aa, Escherichia coli
MNIKGKALLAGCIALAFSNMALAEDIKVAVVGAMSGPVAQYGDQEFTGAEQAVADINAKGGIKGNKLQIVKYDDACDPKQAVAVANKVVNDGIKYVIGHLCSSSTQPASDIYEDEGILMITPAATAPELTARGYQLILRTTGLDSDQGPTAAKYILEKVKPQRIAIVHDKQQYGEGLARAVQDGLKKGNANVVFFDGITAGEKDFSTLVARLKKENIDFVYYGGYHPEMGQILRQARAAGLKTQFMGPEGVANVSLSNIAGESAEGLLVTKPKNYDQVPANKPIVDAIKAKKQDPSGAFVWTTYAALQSLQAGLNQSDDPAEIAKYLKANSVDTVMGPLTWDEKGDLKGFEFGVFDWHANGTATDAK

SEQ ID NO: 1308 - protein, 466 aa, Escherichia coli
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 1309 - protein, 342 aa, Escherichia coli
MLKFIQNNREITALLAVVLLFVLPGFLDRQYLSVQTLTMVYSSAQILILLAMGATLVMLTRNIDVSVGSITGMCAVLLGMLLNAGYSLPVACVATLLLGLLAGFFNGVLVAWLKIPAIVATLGTLGLYRGIMLLWTGGKWIEGLPAELKQLSAPLLLGVSAIGWLTIILVAFMAWLLAKTAFGRSFYATGDNLQGARQLGVRTEAIRIVAFSLNGCMAALAGIVFASQIGFIPNQTGTGLEMKAIAACVLGGISLLGGSGAIIGAVLGAWFLTQIDSVLVLLRIPAWWNDFIAGLVLLAVLVFDGRLRCALERNLRRQKYARFMTPPPSVKPASSGKKREAA

SEQ ID NO: 1310 - protein, 321 aa, Escherichia coli
MGKAVIAIHGGAGAISRAQMSLQQELRYIEALSAIVETGQKMLEAGESALDVVTEAVRLLEECPLFNAGIGAVFTRDETHELDACVMDGNTLKAGAVAGVSHLRNPVLAARLVMEQSPHVMMIGEGAENFAFARGMERVSPEIFSTSLRYEQLLAARKEGATVLDHSGAPLDEKQKMGTVGAVALDLDGNLAAATSTGGMTNKLPGRVGDSPLVGAGCYANNASVAVSCTGTGEVFIRALAAYDIAALMDYGGLSLAEACERVVMEKLPALGGSGGLIAIDHEGNVALPFNTEGMYRAWGYAGDTPTTGIYREKGDTVATQ

SEQ ID NO: 1311 - protein, 336 aa, Escherichia coli
MSALNKKSFLTYLKEGGIYVVLLVLLAIIIFQDPTFLSLLNLSNILTQSSVRIIIALGVAGLIVTQGTDLSAGRQVGLAAVVAATLLQSMDNANKVFPEMATMPIALVILIVCAIGAVIGLINGLIIAYLNVTPFITTLGTMIIVYGINSLYYDFVGASPISGFDSGFSTFAQGFVALGSFRLSYITFYALIAVAFVWVLWNKTRFGKNIFAIGGNPEAAKVSGVNVGLNLLMIYALSGVFYAFGGMLEAGRIGSATNNLGFMYELDAIAACVVGGVSFSGGVGTVIGVVTGVIIFTVINYGLTYIGVNPYWQYIIKGAIIIFAVALDSLKYARKK

SEQ ID NO: 1312 - protein, 322 aa, Escherichia coli
MTMPTNQCPWRMQVHHITQETPDVWTISLICHDYYPYRAGQYALVSVRNSAETLRAYTISSTPGVSEYITLTVRRIDDGVGSQWLTRDVKRGDYLWLSDAMGEFTCDDKAEDKFLLLAAGCGVTPIMSMRRWLAKNRPQADVRVIYNVRTPQDVIFADEWRNYPVTLVAENNVTEGFIAGRLTRELLAGVPDLASRTVMTCGPAPYMDWVEQEVKALGVTRFFKEKFFTPVAEAATSGLKFTKLQPAREFYAPVGTTLLEALESNNVPVVAACRAGVCGCCKTKVVSGEYTVSSTMTLTDAEIAEGYVLACSCHPQGDLVLA

SEQ ID NO: 1313 - protein, 433 aa, Escherichia coli
MLVVELIIVLLAIFLGARLGGIGIGFAGGLGVLVLAAIGVKPGNIPFDVISIIMAVIAAISAMQVAGGLDYLVHQTEKLLRRNPKYITILAPIVTYFLTIFAGTGNISLATLPVIAEVAKEQGVKPCRPLSTAVVSAQIAITASPISAAVVYMSSVMEGHGISYLHLLSVVIPSTLLAVLVMSFLVTMLFNSKLSDDPIYRKRLEEGLVELRGEKQIEIKSGAKTSVWLFLLGVVGVVIYAIINSPSMGLVEKPLMNTTNAILIIMLSVATLTTVICKVDTDNILNSSTFKAGMSACICILGVAWLGDTFVSNNIDWIKDTAGEVIQGHPWLLAVIFFFASALLYSQAATAKALMPMALALNVSPLTAVASFAAVSGLFILPTYPTLVAAVQMDDTGTTRIGKFVFNHPFFIPGTLGVALAVCFGFVLGSFML

SEQ ID NO: 1314 - protein, 340 aa, Escherichia coli
MTFWSILRQRCWGLVLVVAGVCVITFIISHLIPGDPARLLAGDRASDAIVENIRQQLGLDQPLYVQFYRYVSDLFHGDLGTSIRTGRPVLEELRIFFPATLELAFGALLLALLIGIPLGILSAVWRNRWLDHLVRIMAITGISTPAFWLGLGVIVLFYGHLQILPGGGRLDDWLDPPTHVTGFYLLDALLEGNGEVFFNALQHLILPALTLAFVHLGIVARQIRSAMLEQLSEDYIRTARASGLPGWYIVLCYALPNALIPSITVLGLALGDLLYGAVLTETVFAWPGMGAWVVTSIQALDFPAVMGFAVVVSFAYVLVNLVVDLLYLWIDPRIGRGGGE

SEQ ID NO: 1315 - protein, 866 aa, Escherichia coli
MYRTHRQHSLLSSGGVPSFIGGLVVFVSAAFNAQAETWFDPAFFKDDPSMVADLSRFEKGQKITPGVYRVDIVLNQTIVDTRNVNFVEITPEKGIAACLTTESLDAMGVNTDAFPAFKQLDKQACVPLAEIIPDASVTFNVNKLRLEISVPQIAIKSNARGYVPPERWDEGINALLLGYSFSGANSIHSSADSDSGDSYFLNLNSGVNLGPWRLRNNSTWSRSSGQTAEWKNLSSYLQRAVIPLKGELTVGDDYTAGDFFDSVSFRGVQLASDDNMLPDSLKGFAPVVRGIAKSNAQITIKQNGYTIYQTYVSPGAFEISDLYSTSSSGDLLVEIKEADGSVNSYSVPFSSVPLLQRQGRIKYAVTLAKYRTNSNEQQESKFAQATLQWGGPWGTTWYGGGQYAEYYRAAMFGLGFNLGDFGAISFDATQAKSTLADQSEHKGQSYRFLYAKTLNHLGTNFQLMGYRYSTSGFYTLSDTMYKHMDGYEFNDGDDEDTPMWSRYYNLFYTKRGKLQVNISQQLGEYGSFYLSGSQQTYWHTDQQDRLLQFGYNTQIKDLSLGISWNYSKSRGQPDADQVFALNFSLPLNLLLPRSNDSYTRKKNYAWMTSNTSIDNEGHTTQNLGLTETLLDDGNLSYSVQQGYNSEGKTANGSASMDYKGAFADARVGYNYSDNGSQQQLNYALSGSLVAHSQGITLGQSLGETNVLIAAPGAENTRVANSTGLKTDWRGYTVVPYATSYRENRIALDAASLKRNVDLENAVVNVVPTKGALVLAEFNAHAGARVLMKTSKQGIPLRFGAIATLDGVQANSGIIDDDGSLYMAGLPAKGTISVRWGEAPDQICHINYELTEQQINSAITRMDAICR

SEQ ID NO: 1316 - protein, 330 aa, Escherichia coli
MRIRYGWELALAALLVIEIVAFGAINPRMLDLNMLLFSTSDFICIGIVALPLTMVIVSGGIDISFGSTIGLCAIALGVLFQSGVPMPLAILLTLLLGALCGLINAGLIIYTKVNPLVITLGTLYLFAGSALLLSGMAGATGYEGIGGFPMAFTDFANLDVLGLPVPLIIFLICLLVFWLWLHKTHAGRNVFLIGQSPRVALYSAIPVNRTLCALYAMTGLASAVAAVLLVSYFGSARSDLGASFLMPAITAVVLGGANIYGGSGSIIGTAIAVLLVGYLQQGLQMAGVPNQVSSALSGALLIVVVVGRSVSLHRQQIKEWLARRANNPLP

SEQ ID NO: 1317 - protein, 660 aa, Escherichia coli
MSKRIALFPALLLALLVIVATALTWMNFSQALPRSQWAQAAWSPDIDVIEQMIFHYSLLPRLAISLLVGAGLGLVGVLFQQVLRNPLAEPTTLGVATGAQLGITVTTLWAIPGAMASQFAAQAGACVVGLIVFGVAWGKRLSPVTLILAGLVVSLYCGAINQLLVIFHHDQLQSMFLWSTGTLTQTDWGGVERLWPQLLGGVMLTLLLLRPLTLMGLDDGVARNLGLALSLARLAALSLAIVISALLVNAVGIIGFIGLFAPLLAKMLGARRLLPRLMLASLIGALILWLSDQIILWLTRVWMEVSTGSVTALIGAPLLLWLLPRLRSISAPDMKVNDRVAAERQHVLAFALAGGVLLLMAVVVALSFGRDAHGWTWASGALLEDLMPWRWPRIMAALFAGVMLAVAGCIIQRLTGNPMASPEVLGISSGAAFGVVLMLFLVPGNAFGWLLPAGSLGAAVTLLIIMIAAGRGGFSPHRMLLAGMALSTAFTMLLMMLQASGDPRMAQVLTWISGSTYNATDAQVWRTGIVMVILLAITPLCRRWLTILPLGGDTARAVGMALTPTRIALLLLAACLTATATMTIGPLSFVGLMAPHIARMMGFRRTMPHIVISALVGGLLLVFADWCGRMVLFPFQIPAGLLSTFIGAPYFIYLLRKQSR

SEQ ID NO: 1318 - protein, 318 aa, Escherichia coli
MRLAPLYRNALLLTGLLLSGIAAVQAADWPRQITDSRGTHTLESQPQRIVSTSVTLTGSLLAIDAPVIASGATTPNNRVADDQGFLRQWSKVAKERKLQRLYIGEPSAEAVAAQMPDLILISATGGDSALALYDQLSTIAPTLIINYDDKSWQSLLTQLGEITGHEKQAAERIAQFDKQLAAAKEQIKLPPQPVTAIVYTAAAHSANLWTPESAQGQMLEQLGFTLAKLPAGLNASQSQGKRHDIIQLGGENLAAGLNGESLFLFAGDQKDADAIYANPLLAHLPAVQNKQVYALGTETFRLDYYSAMQVLDRLKALF

SEQ ID NO: 1319 - protein, 408 aa, Escherichia coli
MSPCENDTPINWKRNLIVAWLGCFLTGAAFSLVMPFLPLYVEQLGVTGHSALNMWSGIVFSITFLFSAIASPFWGGLADRKGRKLMLLRSALGMGIVMVLMGLAQNIWQFLILRALLGLLGGFVPNANALIATQVPRNKSGWALGTLSTGGVSGALLGPMAGGLLADSYGLRPVFFITASVLILCFFVTLFCIREKFQPVSKKEMLHMREVVTSLKNPKLVLSLFVTTLIIQVATGSIAPILTLYVRELAGNVSNVAFISGMIASVPGVAALLSAPRLGKLGDRIGPEKILITALIFSVLLLIPMSYVQTPLQLGILRFLLGAADGALLPAVQTLLVYNSSNQIAGRIFSYNQSFRDIGNVTGPLMGAAISANYGFRAVFLVTAGVVLFNAVYSWNSLRRRRIPQVSN

SEQ ID NO: 1320 - protein, 489 aa, Escherichia coli
MSTRREVILSWLCEKRQTWRLCYLLGEAGSGKTWLAQQLQKDKHRRVITLSLVVSWQGKAAWIVTDDNAAEQGCRDSAWTRDEMAGQLLHALHRTDSRCPLIIIENAHLNHRRILDDLQRAISLIPDGQFLLIGRPDRKVERDFKKQGIELVSIGRLTEHELKASILEGQNIDQPDLLLTARVLKRIALLCRGDRRKLALAGETIRLLQQAEQTSVFTAKQWRMIYRILGDNRPRKMQLAVVMSGTIIALTCGWLLLSSFTATLPVPAWLIPVTPVVKQDMTKDIAHVVMRDSEALSVLYGVWGYEVPADSAWCDQAVRAGLACKSGNASLQTLVDQNLPWIASLKVGDKKLPVVVVRVGEASVDVLVGQQTWTLTHKWFESVWTGDYLLLWKMSPEGESTITRDSSEEEILWLETMLNRALHISTEPSAEWRPLLVEKIKQFQKSHHLKTDGVVGFSTLVHLWQVAGESAYLYRDEANISPETTVKGK

SEQ ID NO: 1321 - protein, 269 aa, Escherichia coli
MEQSVANLVDMRDVSFTRGNRCIFDNISLTVPRGKITAIMGPSGIGKTTLLRLIGGQIAPDHGEILFDGENIPAMSRSRLYTVRKRMSMLFQSGALFTDMNVFDNVAYPLREHTQLPAPLLHSTVMMKLEAVGLRGAAKLMPSELSGGMARRAALARAIALEPDLIMFDEPFVGQDPITMGVLVKLISELNSALGVTCVVVSHDVPEVLSIADHAWILADKKIVAHGSAQALQANPDPRVRQFLDGIADGPVPFRYPAGDYHADLLPGS

SEQ ID NO: 1322 - protein, 271 aa, Escherichia coli
MPTLRFPFHLANHNKDAAINILIIFISIGSIIFNVNYFHTTIVKNGQIINQPTNAFQSDFSLAALWRNENHAGVKDANPVAVNQETPKLSIALNGIVLTSNDETSFVLINEGSEQKRYSLNEALESAPGTFIRKINKTSVVFETHGHYEKVTLHPGLPDIIKQPDSESQNVLADYIIATPIRDGEQIYGLRLNPRKGLNAFTTSLLQPGDIALRINNLSLTHPDEVSQALSLLLTQQSAQFTIRRNGVPRLINVSVGELTGMNGLRHERTQ

SEQ ID NO: 1323 - protein, 29 aa, Escherichia coli
MSAGVITGVLLVFLLLGYLVYALINAEAF

SEQ ID NO: 1324 - protein, 76 aa, Escherichia coli
MPYKTKSDLPESVKHVLPSHAQDIYKEAFNSAWDQYKDKEDRRDDASREETAHKVAWAAVKHEYAKGDDDKWHKKS

SEQ ID NO: 1325 - protein, 332 aa, Escherichia coli; identical to SEQ ID NO: 2

SEQ ID NO: 1326 - protein, 240 aa, Escherichia coli
MGHKPLYRQIADRIREQIARGELKPGDALPTESALQTEFGVSRVTVRQALRQLVEQQILESIQGSGTYVKEERVNYDIFQLTSFDEKLSDRHVDTHSEVLIFEVIPADDFLQQQLQITPQDRVWHVKRVRYRKQKPMALEETWMPLALFPDLTWQVMENSKYHFIEEVKKMVIDRSEQEIIPLMPTEEMSRLLNISQTKPILEKVSRGYLVDGRVFEYSRNAFNTDDYKFTLIAQRKSSR

SEQ ID NO: 1327 - protein, 414 aa, Escherichia coli
MAMPLSLLIGLRFSRGRRRGGMVSLISVISTIGIALGVAVLIVGLSAMNGFERELNNRILAVVPHGEIEAVDQPWTNWQEALDHVQKVPGIAAAAPYINFTGLVESGANLRAIQVKGVNPQQEQRLSALPSFVQGDAWRNFKAGEQQIIIGKGVADALKVKQGDWVSIMIPNSNPEHKLMQPKRVRLHVAGILQLSGQLDHSFAMIPLADAQQYLDMGSSVSGIALKMTDVFNANKLVRDAGEVTNSYVYIKSWIGTYGYMYRDIQMIRAIMYLAMVLVIGVACFNIVSTLVMAVKDKSGDIAVLRTLGAKDGLIRAIFVWYGLLAGLFGSLCGVIIGVVVSLQLTPIIEWIEKLIGHQFLSSDIYFIDFLPSELHWLDVFYVLVTALLLSLLASWYPARRASNIDPARVLSGQ

SEQ ID NO: 1328 - protein, 485 aa, Escherichia coli
MKTPSQPRAIYYIVAIQIWEYFSFYGMRALLILYLTHQLGFDDNHAISLFSAYASLVYVTPILGGWLADRLLGNRTAVIAGALLMTLGHVVLGIDTNSTFSLYLALAIIICGYGLFKSNISCLLGELYDENDHRRDGGFSLLYAAGNIGSIAAPIACGLAAQWYGWHVGFALAGGGMFIGLLIFLSGHRHFQSTRSMDKKALTSVKFALPVWSWLVVMLCLAPVFFTLLLENDWSGYLLAIVCLIAAQIIARMMIKFPEHRRALWQIVLLMFVGTLFWVLAQQGGSTISLFIDRFVNRQAFNIEVPTALFQSVNAIAVMLAGVVLAWLASPESRGNSTLRVWLKFAFGLLLMACGFMLLAFDARHAAADGQASMGVMISGLALMGFAELFIDPVAIAQITRLKMSGVLTGIYMLATGAVANWLAGVVAQQTTESQISGMAIAAYQRFFSQMGEWTLACVAIIVVLAFATRFLFSTPTNMIQESND

SEQ ID NO: 1329 - protein, 318 aa, Escherichia coli
MKIALVIFITLALAGCALLSLHMGVIPVPWRALLTDWQAGHEHYYVLMEYRLPRLLLALFVGAALAVAGVLIQGIVRNPLASPDILGVNHAASLASVGALLLMPSLPVMVLPLLAFAGGMAGLILLKMLAKTHQPMKLALTGVALSACWASLTDYLMLSRPQDVNNALLWLTGSLWGRDWSFVKIAIPLMILFLPLSLSFCRDLDLLALGDARATTLGVSVPHTRFWALLLAVAMTSTGVAACGPISFIGLVVPHMMRSITGGRHRRLLPVSALTGALLLVVADLLARIIHPPLELPVGVLTAIIGAPWFVWLLVRMR

SEQ ID NO: 1330 - protein, 75 aa, Escherichia coli
MQYTPDTAWKITGFSREISPAYRQKLLSLGMLPGSSFNVVRVAPLGDPIHIETRRVSLVLRKKDLALLEVEAVSC

SEQ ID NO: 1331 - protein, 472 aa, Escherichia coli
MVNLVIVSHSSRLGEGVGELARQMLMSDSCKIAIAAGIDDPQNPIGTDAVKVMEAIESVADADHVLVMMDMGSALLSAETALELLAPEIAAKVRLCAAPLVEGTLAATVSAASGADIDKVIFDAMHALEAKREQLGLPSSDTEISDTCPAYDEEARSLAVVIKNRNGLHVRPASRLVYTLSTFNADMLLEKNGKCVTPESINQIALLQVRYNDTLRLIAKGPEAEEALIAFRQLAEDNFGETEEVAPPTLRPVPPVSGKAFYYQPVLCTVQAKSTLTVEEEQDRLRQAIDFTLLDLMTLTAKAEASGLDDIAAIFSGHHTLLDDPELLAAASELLQHEHCTAEYAWQQVLKELSQQYQQLDDEYLQARYIDVDDLLHRTLVHLTQTKEELPQFNSPTILLAENIYPSTVLQLDPAVVKGICLSAGSPVSHSALIARELGIGWICQQGEKLYAIQPEETLTLDVKTQRFNRQG

SEQ ID NO: 1332 - protein, 302 aa, Escherichia coli
MQLRKPATAILALALSAGLAQADDAAPAAGSTLDKIAKNGVIVVGHRESSVPFSYYDNQQKVVGYSQDYSNAIVEAVKKKLNKPDLQVKLIPITSQNRIPLLQNGTFDFECGSTTNNVERQKQAAFSDTIFVVGTRLLTKKGGDIKDFANLKDKAVVVTSGTTSEVLLNKLNEEQKMNMRIISAKDHGDSFRTLESGRAVAFMMDDALLAGERAKAKKPDNWEIVGKPQSQEAYGCMLRKDDPQFKKLMDDTIAQVQTSGEAEKWFDKWFKNPIPPKNLNMNFELSDEMKALFKEPNDKALN

SEQ ID NO: 1333 - protein, 220 aa, Escherichia coli
MMFWRIFRLELRVAFRHSAEIANPLWFFLIVITLFPLSIGPEPQLLARIAPGIIWVAALLSSLLALERLFRDDLQDGSLEQLMLLPLPLPAVVLAKVMAHWMVTGLPLLILSPLVAMLLGMDVYGWQVMALTLLLGTPTLGFLGAPGVALTVGLKRGGVLLSILVLPLTIPLLIFATAAMDAASMHLPVDGYLAILGALLAGTATLSPFATAAALRISIQ

SEQ ID NO: 1334 - protein, 177 aa, Escherichia coli
MSEFITVARPYAKAAFDFAVEHQSVERWQDMLAFAAEVTKNEQMAELLSGALAPETLAESFIAVCGEQLDENGQNLIRVMAENGRLNALPDVLEQFIHLRAVSEATAEVDVISAAALSEQQLAKISAAMEKRLSRKVKLNCKIDKSVMAGVIIRAGDMVIDGSVRGRLERLADVLQS

SEQ ID NO: 1335 - protein, 245 aa, Escherichia coli
MWKTLHQLAIPPRLYQICGWFIPWLAIASVVVLTVGWIWGFGFAPADYQQGNSYRIIYLHVPAAIWSMGIYASMAVAAFIGLVWQMKMANLAVAAMAPIGAVFTFIALVTGSAWGKPMWGTWWVWDARLTSELVLLFLYVGVIALWHAFDDRRLAGRAAGILVLIGVVNLPIIHYSVEWWNTLHQGSTRMQQSIDPAMRSPLRWSIFGFLLLSATLTLMRMRNLILLMEKRRPWVSELILKRGRK

SEQ ID NO: 1336 - protein, 215 aa, Escherichia coli
MKLYIYDHCPYCLKARMIFGLKNIPVELHVLLNDDAETPTRMVGQKQVPILQKDDSRYMPESMDIVHYVDKLDGKPLLTGKRSPAIEEWLRKVNGYANKLLLPRFAKSAFDEFSTPAARKYFVDKKEASAGNFADLLAHSDGLIKNISDDLRALDKLIVKPNAVNGELSEDDIQLFPLLRNLTLVAGINWPSRVADYRDNMAKQTQINLLSSMAI

SEQ ID NO: 1337 - protein, 224 aa, Escherichia coli
MYEFDWSSIVPSLPYLLDGLVITLKITVTAVVIGILWGTMLAVMRLSSFAPVAWFAKAYVNVFRSIPLVMVLLWFYLIVPGFLQNVLGLSPKNDIRLISAMVAFSMFEAAYYSEIIRAGIQSISRGQSSAALALGMTHWQSMKLIILPQAFRAMVPLLLTQGIVLFQDTSLVYVLSLADFFRTASTIGERDGTQVEMILFAGFVYFVISLSASLLVSYLKRRTA

SEQ ID NO: 1338 - protein, 83 aa, Escherichia coli
MANVEIYTKETCPYCHRAKALLSSKGVSFQELPIDGNAAKREEMIKRSGRTTVPQIFIDAQHIGGCDDLYALDARGGLDPLLK

SEQ ID NO: 1339 - protein, 327 aa, Escherichia coli
MQIKRSIEKIPGGMMLVPLFLGALCHTFSPGAGKYFGSFTNGMITGTVPILAVWFFCMGASIKLSATGTVLRKSGTLVVTKIAVAWVVAAIASRIIPEHGVEVGFFAGLSTLALVAAMDMTNGGLYASIMQQYGTKEEAGAFVLMSLESGPLMTMIILGTAGIASFEPHVFVGAVLPFLVGFALGNLDPELREFFSKAVQTLIPFFAFALGNTIDLTVIAQTGLLGILLGVAVIIVTGIPLIIADKLIGGGDGTAGIAASSSAGAAVATPVLIAEMVPAFKPMAPAATSLVATAVIVTSILVPILTSIWSRKVKARAAKIEILGTVK

SEQ ID NO: 1340 - protein, 211 aa, Escherichia coli [sequence omitted]

SEQ ID NO: 1341 - protein, 296 aa, Escherichia coli
MAMVEMQTTAALAESRRKMQARRRLKNRIALTLSMATMAFGLFWLIWILMSTITRGIDGMSLALFTEMTPPPNTEGGGLANALAGSGLLILWATVFGTPLGIMAGIYLAEYGRKSWLAEVIRFINDILLSAPSIVVGLFVYTIVVAQMEHFSGWAGVIALALLQVPIVIRTTENMLKLVPYSLREAAYALGTPKWKMISAITLKASVSGIMTGILLAIARIAGETAPLLFTALSNQFWSTDMMQPIANLPVTIFKFAMSPFAEWQQLAWAGVLIITLCVLLLNILARVVFAKNKHG

SEQ ID NO: 1342 - protein, 323 aa, Escherichia coli
MTIAIVIGTHGWAAEQLLKTAEMLLGEQENVGWIDFVPGENAETLIEKYNAQLAKLDTTKGVLFLVDTWGGSPFNAASRIVVDKEHYEVIAGVNIPMLVETLMARDDDPSFDELVALAVETGREGVKALKAKPVEKAAPAPAAAAPKAAPTPAKPMGPNDYMVIGLARIDDRLIHGQVATRWTKETNVSRIIVVSDEVAADTVRKTLLTQVAPPGVTAHVVDVAKMIRVYNNPKYAGERVMLLFTNPTDVERLVEGGVKITSVNVGGMAFRQGKTQVNNAVSVDEKDIEAFKKLNARGIELEVRKVSTDPKLKMMDLISKIDK

SEQ ID NO: 1343 - protein, 283 aa, Escherichia coli
MVDTTQTTTEKKLTQSDIRGVFLRSNLFQGSWNFERMQALGFCFSMVPAIRRLYPENNEARKQAIRRHLEFFNTQPFVAAPILGVTLALEEQRANGAEIDDGAINGIKVGLMGPLAGVGDPIFWGTVRPVFAALGAGIAMSGSLLGPLLFFILFNLVRLATRYYGVAYGYSKGIDIVKDMGGGFLQKLTEGASILGLFVMGALVNKWTHVNIPLVVSRITDQTGKEHVTTVQTILDQLMPGLVPLLLTFACMWLLRKKVNPLWIIVGFFVIGIAGYACGLLGL

SEQ ID NO: 1344 - protein, 206 aa, Escherichia coli
MTLEWWFAYLLTSIILSLSPGSGAINTMTTSLNHGYRGAVASIAGLQTGLAIHIVLVGVGLGTLFSRSVIAFEVLKWAGAAYLIWLGIQQWRAAGAIDLKSLASTQSRRHLFQRAVFVNLTNPKSIVFLAALFPQFIMPQQPQLMQYIVLGVTTIVVDIIVMIGYATLAQRIALWIKGPKQMKALNKIFGSLFMLVGALLASARHA

SEQ ID NO: 1345 - protein, 123 aa, Escherichia coli
MTVIYQTTITRIGASAIDALSDQMLITFREGAPADLEEYCFIHCHGELKGALHPGLQFSLGQHRYPVTAVGSVAEDNLRELGHVTLRFDGLNEAEFPGTVHVAGPVPDDIAPGSVLKFESVKE

SEQ ID NO: 1346 - protein, 212 aa, Escherichia coli
MKKLTVAALAVTTLLSGSAFAHEAGEFFMRAGSATVRPTEGAGGTLGSLGGFSVTNNTQLGLTFTYMATDNIGVELLAATPFRHKIGTRATGDIATVHHLPPTLMAQWYFGDASSKFRPYVGAGINYTTFFDNGFNDHGKEAGLSDLSLKDSWGAAGQVGVDYLINRDWLVNMSVWYMDIDTTANYKLGGAQQHDSVRLDPWVFMFSAGYRF

SEQ ID NO: 1347 - protein, 116 aa, Escherichia coli
MMDLDNIPDTQTEAEELEEVVMGLIINSGQARSLAYAALKQAKQGDFAAAKAMMDQSRMALNEAHLVQTKLIEGDAGEGKMKVSLVLVHAQDHLMTSMLARELITELIELHEKLKA

SEQ ID NO: 1348 - protein, 452 aa, Escherichia coli
MSNVIASLEKVLLPFAVKIGKQPHVNAIKNGFIRLMPLTLAGAMFVLINNVFLSFGEGSFFYSLGIRLDASTIETLNGLKGIGGNVYNGTLGIMSLMAPFFIGMALAEERKVDALAAGLLSVAAFMTVTPYSVGEAYAVGANWLGGANIISGIIIGLVVAEMFTFIVRRNWVIKLPDSVPASVSRSFSALIPGFIILSVMGIIAWALNTWGTNFHQIIMDTISTPLASLGSVVGWAYVIFVPLLWFFGIHGALALTALDNGIMTPWALENIATYQQYGSVEAALAAGKTFHIWAKPMLDSFIFLGGSGATLGLILAIFIASRRADYRQVAKLALPSGIFQINEPILFGLPIIMNPVMFIPFVLVQPILAAITLAAYYMGIIPPVTNIAPWTMPTGLGAFFNTNGSVAALLVALFNLGIATLIYLPFVVVANKAQNAIDKEESEEDIANALKF

SEQ ID NO: 1349 - protein, 509 aa, Escherichia coli
MLLPWLILIPFIGGFLCWQTERFGVKVPRWIALITMGLTLALSLQLWLQGGYSLTQSAGIPQWQSEFDMPWIPRFGISIHLAIDGLSLLMVVLTGLLGVLAVLCSWKEIEKYQGFFHLNLMWILGGVIGVFLAIDMFLFFFFWEMMLVPMYFLIALWGHKASDGKTRITAATKFFIYTQASGLVMLIAILALVFVHYNATGVWTFNYEELLNTPMSSGVEYLLMLGFFIAFAVKMPVVPLHGWLPDAHSQAPTAGSVDLAGILLKTAAYGLLRFSLPLFPNASAEFAPIAMWLGVIGIFYGAWMAFAQTDIKRLIAYTSVSHMGFVLIAIYTGSQLAYQGAVIQMIAHGLSAAGLFILCGQLYERIHTRDMRMMGGLWSKMKWLPALSLFFAVATLGMPGTGNFVGEFMILFGSFQVVPVITVISTFGLVFASVYSLAMLHRAYFGKAKSQIASQELPGMSLRELFMILLLVVLLVLLGFYPQPILDTSHSAIGNIQQWFVNSVTTTRP

SEQ ID NO: 1350 - protein, 513 aa, Escherichia coli
MEISWGRALWRNFLGQSPDWYKLALIIFLIVNPLIFLISPFVAGWLLVAEFIFTLAMALKCYPLLPGGLLAIEAVFIGMTSAEHVREEVAANLEVLLLLMFMVAGIYFMKQLLLFIFTRLLLSIRSKMLLSLSFCVAAAFLSAFLDALTVVAVVISVAVGFYGIYHRVASSRTEDTDLQDDSHIDKHYKVVLEQFRGFLRSLMMHAGVGTALGGVMTMVGEPQNLIIAKAAGWHFGDFFLRMSPVTVPVLICGLLTCLLVEKLRWFGYGETLPEKVREVLQQFDDQSRHQRTRQDKIRLIVQAIIGVWLVTALALHLAEVGLIGLSVIILATSLTGVTDEHAIGKAFTESLPFTALLTVFFSVVAVIIDQQLFSPIIQFVLQASEHAQLSLFYIFNGLLSSISDNVFVGTIYINEAKAAMESGAITLKQYELLAVAINTGTNLPSVATPNGQAAFLFLLTSALAPLIRLSYGRMVWMALPYTLVLTLVGLLCVEFTLAPVTEWFMQMGWIATL

SEQ ID NO: 1351 - protein, 81 aa, Escherichia coli
MRITIYTRNDCVQCHATKRAMENRGFDFEMINVDRVPEAAEALRAQGFRQLPVVIAGDLSWSGFRPDMINRLHPAPHAASA

SEQ ID NO: 1352 - protein, 150 aa, Escherichia coli
MTNLFVRSGISFVDRSEVLTHIGNEMLAKGVVHDTWPQALIAREAEFPTGIMLEQHAIAIPHCEAIHAKSSAIYLLRPTNKVHFQQADDDNDVAVSLVIALIVENPQQQLKLLRCLFGKLQQPDIVETLITLPETQLKEYFTKYVLDSDE

SEQ ID NO: 1353 - protein, 613 aa, Escherichia coli
MNMLALTIILPLIGFVLLAFSRGRWSENVSAIVGVGSVGLAALVTAFIGVDFFANGEQTYSQPLWTWMSVGDFNIGFNLVLDGLSLTMLSVVTGVGFLIHMYASWYMRGEEGYSRFFAYTNLFIASMVVLVLADNLLLMYLGWEGVGLCSYLLIGFYYTDPKNGAAAMKAFVVTRVGDVFLAFALFILYNELGTLNFREMVELAPAHFADGNNMLMWATLMLLGGAVGKSAQLPLQTWLADAMAGPTPVSALIHAATMVTAGVYLIARTHGLFLMTPEVLHLVGIVGAVTLLLAGFAALVQTDIKRVLAYSTMSQIGYMFLALGVQAWDAAIFHLMTHAFFKALLFLASGSVILACHHEQNIFKMGGLRKSIPLVYLCFLVGGAALSALPLVTAGFFSKDEILAGAMANGHINLMVAGLVGAFMTSLYTFRMIFIVFHGKEQIHAHAVKGVTHSLPLIVLLILSTFVGALIVPPLQGVLPQTTELAHGSMLTLEITSGVVAVVGILLAAWLWLGKRTLVTSIANSAPGRLLGTWWYNAWGFDWLYDKVFVKPFLGIAWLLKRDPLNSMMNIPAVLSRFAGKGLLLSENGYLRWYVASMSIGAVVVLALLMVLR

SEQ ID NO: 1354 - protein, 266 aa, Escherichia coli
MEITTLQIVLVFIVACIAGMGSILDEFQFHRPLIACTLVGIVLGDMKTGIIIGGTLEMIALGWMNIGAAVAPDAALASIISTILVIAGHQSIGAGIALAIPLAAAGQVLTIIVRTITVAFQHAADKAADNGNLTAISWIHVSSLFLQAMRVAIPAVIVALSVGTSEVQNMLNAIPEVVTNGLNIAGGMIVVVGYAMVINMMRAGYLMPFFYLGFVTAAFTNFNLVALGVIGTVMAVLYIQLSPKYNRVAGAPAQAAGNNDLDNELD

SEQ ID NO: 1355 - protein, 447 aa, Escherichia coli
MSNLSLDFSDNTFQPLAARMRPENLAQYIGQQHLLAAGKPLPRAIEAGHLHSMILWGPPGTGKTTLAEVIARYANADVERISAVTSGVKEIREAIERARQNRNAGRRTILFVDEVHRFNKSQQDAFLPHIEDGTITFIGATTENPSFELNSALLSRARVYLLKSLSTEDIEQVLTQAMEDKTRGYGGQDIVLPDETRRAIAELVNGDARRALNTLEMMADMAEVDDSGKRVLKPELLTEIAGERSARFDNKGDRFYDLISALHKSVRGSAPDAALYWYARIITAGGDPLYVARRCLAIASEDVGNADPRAMQVAIAAWDCFTRVGPAEGERAIAQAIVYLACAPKSNAVYTAFKAALADARERPDYDVPVHLRNAPTKLMKEMGYGQEYRYAHDEANAYAAGEVYFPPEIAQTRYYFPTNRGLEGKIGEKLAWLAEQDQNSPIKRYR

SEQ ID NO: 1356 - protein, 106 aa, Escherichia coli
MEKKHIYLFCSAGMSTSLLVSKMRAQAEKYEVPVIIEAFPETLAGEKGQNADVVLLGPQIAYMLPEIQRLLPNKPVEVIDSLLYGKVDGLGVLKAAVAAIKKAAAN

SEQ ID NO: 1357 - protein, 327 aa, Escherichia coli
MALLNVDKLSVHFGDESAPFRAVDRISYSVKQGEVVGIVGESGSGKSVSSLAIMGLIDYPGRVMAEKLEFNGQDLQRISEKERRNLVGAEVAMIFQDPMTSLNPCYTVGFQIMEAIKVHQGGNKSTRRQRAIDLLNQVGIPDPASRLDVYPHQLSGGMSQRVMIAMAIACRPKLLIADEPTTALDVTIQAQIIELLLELQQKENMALVLITHDLALVAEAAHKIIVMYAGQVVETGDAHAIFHAPRHPYTQALLRALPEFAQDKERLASLPGVVPGKYDRPNGCLLNPRCPYATDRCRAEEPALNMLADGRQSKCHYPLDDAGRPTL

SEQ ID NO: 1358 - protein, 488 aa, Escherichia coli
MINRQLSRLLLCSILGSTTLISGCALVRKDSAPHQQLKPEQIKLADDIHLASSGWPQAQWWKQLNDPQLDALIQRTLSGSHTLAEAKLREEKAQSQADLLDAGSQLQVAALGMLNRQRVSANGFLSPYSMDAPALGMDGPYYTEATVGLFAGLDLDLWGVHRSAVAAAIGAHNAALAETAAVELSLATGVAQLYYSMQASYQMLDLLEQTHDVIDYAVKAHQSKVAHGLEAQVPFHGARAQILAVDKQIVAVKGQITETRESLRALIGAGASDMPEIRPVALPQVQTGIPATLSYELLARRPDLQAMRWYVQASLDQVDSARALFYPSFDIKAFFGLDSIHLHTLFKKTSRQFNFIPGLKLPLFDGGRLNANLEGTRAASNMMIERYNQSVLNAVRDVAVNGTRLQTLNDEREMQAERVEATRFTQRAAEAAYQRGLTSRLQATEARLPVLAEEMSLLMLDSRRVIQSIQLMKSLGGGYQAGPVVEKK

SEQ ID NO: 1359 - protein, 180 aa, Escherichia coli
MFTFIKKVIKTGTATSSYPLEPIAVDKNFRGKPEQNPQQCIGCAACVNACPSNALTVETDLATGELAWEFNLGHCIFCGRCEEVCPTAAIKLSQEYELAVWKKEDFLQQSRFALCNCRVCNRPFAVQKEIDYAIALLKHNGDSRAENHRESFETCPECKRQKCLVPSDRIELTRHMKEAI

SEQ ID NO: 1360 - protein, 299 aa, Escherichia coli
MFSGLLIILVPLIVGYLIPLRQQAALKVINQLLSWMVYLILFFMGISLAFLDNLASNLLAILHYSAVSITVILLCNIAALMWLERGLPWRNHHQQEKLPSRIAMALESLKLCGVVVIGFAIGLSGLAFLQHATEASEYTLILLLFLVGIQLRNNGMTLKQIVLNRRGMIVAVVVVVSSLIGGLINAFILDLPINTALAMASGFGWYSLSGILLTESFGPVIGSAAFFNDLARELIAIMLIPGLIRRSRSTALGLCGATSMDFTLPVLQRTGGLDMVPAAIVHGFILSLLVPILIAFFSA

SEQ ID NO: 1361 - protein, 321 aa, Escherichia coli
MTTQTVSGRRYFTKAWLMEQKSLIALLVLIAIVSTLSPNFFTINNLFNILQQTSVNAIMAVGMTLVILTSGIDLSVGSLLALTGAVAASIVGIEVNALVAVAAALALGAAIGAVTGVIVAKGRVQAFIATLVMMLLLRGVTMVYTNGSPVNTGFTENADLFGWFGIGRPLGVPTPVWIMGIVFLAAWYMLHHTRLGRYIYALGGNEAATRLSGINVNKIKIIVYSLCGLLASLAGIIEVARLSSAQPTAGTGYELDAIAAVVLGGTSLAGGKGRIVGTLIGALILGFLNNGLNLLGVSSYYQMIVKAVVILLAVLVDNKKQ

SEQ ID NO: 1362 - protein, 148 aa, Escherichia coli
MAALTASCIDLNIQGNGAYSVLKQLATIALQNGFITDSHQFLQTLLLREKMHSTGFGSGVAVPHGKSACVKQPFVLFARKAQAIDWKASDGEDVNCWICLGVPQSGEEDQVKIIGTLCRKIIHKEFIHQLQQGDTDQVLALLNQTLSS

SEQ ID NO: 1363 - protein, 139 aa, Escherichia coli
MKKGTVLNSDISSVISRLGHTDTLVVCDAGLPIPKSTTRIDMALTQGVPSFMQVLGVVTNEMQVEAAIIAEEIKHHNPQLHETLLTHLEQLQKHQGNTIEIRYTTHEQFKQQTAESQAVIRSGECSPYANIILCAGVTF

SEQ ID NO: 1364 - protein, 368 aa, Escherichia coli
MLSQIQRFGGAMFTPVLLFPFAGIVVGLAILLQNPMFVGESLTDPNSLFAQIVHIIEEGGWTVFRNMPLIFAVGLPIGLAKQAQGRACLAVMVSFLTWNYFINAMGMTWGSYFGVDFTQDAVAGSGLTMMAGIKTLDTSIIGAIIISGIVTALHNRLFDKKLPVFLGIFQGTSYVVIIAFLVMIPCAWLTLLGWPKVQMGIESLQAFLRSAGALGVWVYTFLERILIPTGLHHFIYGQFIFGPAAVEGGIQMYWAQHLQEFSLSAEPLKSLFPEGGFALHGNSKIFGAVGISLAMYFTAAPENRVKVAGLLIPATLTAMLVGITEPLEFTFLFISPLLFAVHAVLAASMSTVMYLFGVVGNMGGGLID

SEQ ID NO: 1365 - protein, 136 aa, Escherichia coli
MSIIKEFREFAMRGNVVDLAVGVIIGAAFGKIVSSLVADIIMPPLGLLIGGIDFKQFAVTLRDAQGDIPAVVMHYGVFIQNVFDFLIVAFAIFMAIKLINKLNRKKEEPAAAPAPTKEEVLLTEIRDLLKEQNNRS

SEQ ID NO: 1366 - protein, 362 aa, Escherichia coli
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 1367 - protein, 108 aa, Escherichia coli
MSKKLIALCACPMGLAHTFMAAQALEEAAVEAGYEVKIETQGADGIQNRLTAQDIAEATIIIHSVAVTPEDNERFESRDVYEITLQDAIKNAAGIIKEIEEMIASEQQ

SEQ ID NO: 1368 - protein, 286 aa, Escherichia coli
MEDLNVVDSINGAGSWLVANQALLLSYAVNIVAALAIIIVGLIIARMISNAVNRLMISRKIDATVADFLSALVRYGIIAFTLIAALGRVGVQTASVIAVLGAAGLAVGLALQGSLSNLAAGVLLVMFRPFRAGEYVDLGGVAGTVLSVQIFSTTMRTADGKIIVIPNGKIIAGNIINFSREPVRRNEFIIGVAYDSDIDQVKQILTNIIQSEDRILKDREMTVRLNELGASSINFVVRVWSNSGDLQNVYWDVLERIKREFDAAGISFPYPQMDVNFKRVKEDKAA

SEQ ID NO: 1369 - protein, 512 aa, Escherichia coli
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTVCSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPVLRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 1370 - protein, 462 aa, Escherichia coli
MALQNEKNSRYLLRDWKPENPAFWENKGKHIARRNLWISVSCLLLAFCVWMLFSAVTVNLNKIGFNFTTDQLFLLTALPSVSGALLRVPYSFMVPIFGGRRWTVFSTAILIIPCVWLGIAVQNPNTPFGIFIVIALLCGFAGANFASSMGNISFFFPKAKQGSALGINGGLGNLGVSVMQLVAPLVIFVPVFAFLGVNGVPQADGSVMSLANAAWIWVPLLAIATIAAWSGMNDIASSRASIADQLPVLQRLHLWLLSLLYLATFGSFIGFSAGFAMLAKTQFPDVNILRLAFFGPFIGAIARSVGGAISDKFGGVRVTLINFIFMAIFSALLFLTLPGTGSGNFIAFYAVFMGLFLTAGLGSGSTFQMIAVIFRQITIYRVKMKGGSDEQAHKEAVTETAAALGFISAIGAVGGFFIPQAFGMSLNMTGSPVGAMKVFLIFYIVCVLLTWLVYGRRKFSQK

SEQ ID NO: 1371 - protein, 582 aa, Escherichia coli
MHNDKDLSTWQTFRRLWPTIAPFKAGLIVAGVALILNAASDTFMLSLLKPLLDDGFGKTDRSVLVWMPLVVIGLMILRGITSYVSSYCISWVSGKVVMTMRRRLFGHMMGMPVSFFDKQSTGTLLSRITYDSEQVASSSSGALITVVREGASIIGLFIMMFYYSWQLSIILIVLAPIVSIAIRVVSKRFRNISKNMQNTMGQVTTSAEQMLKGHKEVLIFGGQEVETKRFDKVSNRMRLQGMKMVSASSISDPIIQLIASLALAFVLYAASFPSVMDSLTAGTITVVFSSMIALMRPLKSLTNVNAQFQRGMAACQTLFTILDSEQEKDEGKRVIERATGDVEFRNVTFTYPGRDVPALRNINLKIPAGKTVALVGRSGSGKSTIASLITRFYDIDEGEILMDGHDLREYTLASLRNQVALVSQNVHLFNDTVANNIAYARTEQYSREQIEEAARMAYAMDFINKMDNGLDTVIGENGVLLSGGQRQRIAIARALLRDSPILILDEATSALDTESERAIQAALDELQKNRTSLVIAHRLSTIEKADEIVVVEDGVIVERGTHNDLLEHRGVYAQLHKMQFGQ

SEQ ID NO: 1372 - protein, 155 aa, Escherichia coli
MSRRAGTPTAKKVTQLVNVEEHVEGFRQVREAHRRELIDDYVELISDLIREVGEARQVDMAARLGVSQPTVAKMLKRLATMGLIEMIPWRGVFLTAEGEKLAQESRERHQIVENFLLVLGVSPEIARRDAEGMEHHVSEETLDAFRLFTQKHGAK

SEQ ID NO: 1373 - protein, 396 aa, Escherichia coli
MNDTSFENCIKCTVCTTACPVSRVNPGYPGPKQAGPDGERLRLKDGALYDEALKYCINCKRCEVACPSDVKIGDIIQRARAKYDTTRPSLRNFVLSHTDLMGSVSTPFAPIVNTATSLKPVRQLLDAALKIDHRRTLPKYSFGTFRRWYRSVAAQQAQYKDQVAFFHGCFVNYNHPQLGKDLIKVLNAMGTGVQLLSKEKCCGVPLIANGFTDKARKQAITNVESIREAVGVKGIPVIATSSTCTFALRDEYPEVLNVDNKGLRDHIELATRWLWRKLDEGKTLPLKPLPLKVVYHTPCHMEKMGWTLYTLELLRNIPGLELTVLDSQCCGIAGTYGFKKENYPTSQAIGAPLFRQIEESGADLVVTDCETCKWQIEMSTSLRCEHPITLLAQALA

SEQ ID NO: 1374 - protein, 443 aa, Escherichia coli
MEIASNKGVIADASTPAGRAGMSESEWREAIKFDSTDTGWVIMSIGMAIGAGIVFLPVQVGLMGLWVFLLSSVIGYPAMYLFQRLFINTLAESPECKDYPSVISGYLGKNWGILLGALYFVMLVIWMFVYSTAITNDSASYLHTFGVTEGLLSDSPFYGLVLICILVAISSRGEKLLFKISTGMVLTKLLVVAALGVSMVGMWHLYNVGSLPPLGLLVKNAIITLPFTLTSILFIQTLSPMVISYRSREKSIEVARHKALRAMNIAFGILFVTVFFYAVSFTLAMGHDEAVKAYEQNISALAIAAQFISGDGAAWVKVVSVILNIFAVMTAFFGVYLGFREATQGIVMNILRRKMPAEKINENLVQRGIMIFAILLAWSAIVLNAPVLSFTSICSPIFGMVGCLIPAWLVYKVPALHKYKGMSLYLIIVTGLLLCVSPFLAFS

SEQ ID NO: 1375 - protein, 257 aa, Escherichia coli
MARKWLNLFAGAALSFAVAGNALADEGKITVFAAASLTNAMQDIATQFKKEKGVDVVSSFASSSTLARQIEAGAPADLFISADQKWMDYAVDKKAIDTATRQTLLGNSLVVVAPKASVQKDFTIDSKTNWTSLLNGGRLAVGDPEHVPAGIYAKEALQKLGAWDTLSPKLAPAEDVRGALALVERNEAPLGIVYGSDAVASKGVKVVATFPEDSHKKVEYPVAVVEGHNNATVKAFYDYLKGPQAAEIFKRYGFTIK

SEQ ID NO: 1376 - protein, 266 aa, Escherichia coli [sequence omitted]

SEQ ID NO: 1377 - protein, 524 aa, Escherichia coli
MLSTLRRTLFALLACASFIVHAAAPDEITTAWPVNVGPLNPHLYTPNQMFAQSMVYEPLVKYQADGSVIPWLAKSWTHSEDGKTWTFTLRDDVKFSNGEPFDAEAAAENFRAVLDNRQRHAWLELANQIVDVKALSKTELQITLKSAYYPFLQELALPRPFRFIAPSQFKNHETMNGIKAPIGTGPWILQESKLNQYDVFVRNENYWGEKPAIKKITFNVIPDPTTRAVAFETGDIDLLYGNEGLLPLDTFARFSQNPAYHTQLSQPIETVMLALNTAKAPTNELAVREALNYAVNKKSLIDNALYGTQQVADTLFAPSVPYANLGLKPSQYDPQKAKALLEKAGWTLPAGKDIREKNGQPLRIELSFIGTDALSKSMAEIIQADMRQIGADVSLIGEEESSIYARQRDGRFGMIFHRTWGAPYDPHAFLSSMRVPSHADFQAQQGLADKPLIDKEIGEVLATHDETQRQALYRDILTRLHDEAVYLPISYISMMVVSKPELGNIPYAPIATEIPFEQIKPVKP

SEQ ID NO: 1378 - protein, 275 aa, Escherichia coli
MIVTIVGWLVLFVFLPNLMIIGTSFLTRDDASFVKMVFTLDNYTRLLDPLYFEVLLHSLNMALIATLACLVLGYPFAWFLAKLPHKVRPLLLFLLIVPFWTNSLIRIYGLKIFLSTKGYLNEFLLWLGVIDTPIRIMFTPSAVIIGLVYILLPFMVMPLYSSIEKLDKPLLEAARDLGASKLQTFIRIIIPLTMPGIIAGCLLVMLPAMGLFYVSDLMGGAKNLLIGNVIKVQFLNIRDWPFGAATSITLTIVMGLMLLVYWRASRLLNKKVELE

SEQ ID NO: 1379 - protein, 306 aa, Escherichia coli
MLKFILRRCLEAIPTLFILITISFFMMRLAPGSPFTGERTLPPEVMANIEAKYHLNDPIMTQYFSYLKQLAHGDFGPSFKYKDYSVNDLVASSFPVSAKLGAAAFFLAVILGVSAGVIAALKQNTKWDYTVMGLAMTGVVIPSFVVAPLLVMIFAIILHWLPGGGWNGGALKFMILPMVALSLAYIASIARITRGSMIEVLHSNFIRTARAKGLPMRRIILRHALKPALLPVLSYMGPAFVGIITGSMVIETIYGLPGIGQLFVNGALNRDYSLVLSLTILVGALTILFNAIVDVLYAVIDPKIRY

SEQ ID NO: 1380 - protein, 264 aa, Escherichia coli
MIGRLLRGGFMTAIYAYLYIPIIILIVNSFNSSRFGINWQGFTTKWYSLLMNNDSLLQAAQHSLTMAVFSATFATLIGSLTAVALYRYRFRGKPFVSGMLFVVMMSPDIVMAISLLVLFMLLGIQLGFWSLLFSHITFCLPFVVVTVYSRLKGFDVRMLEAAKDLGASEFTILRKIILPLAMPAVAAGWVLSFTLSMDDVVVSSFVTGPSYEILPLKIYSMVKVGVSPEVNALATILLVLSLVMVIASQLIARDKTKGNTGDVK

SEQ ID NO: 1381 - protein, 181 aa, Escherichia coli
MLKLLKTIMRAGTATVKYPFAPLEVSPGFRGKPDLMPSQCIACGACACACPANALTIQTDDQQNSRTWQLYLGRCIYCGRCEEVCPTRAIQLTNNFELTVTNKADLYTRATFHLQRCSRCERPFAPQKTIALAAELLAQQQNAPQNREMLWAQASVCPECKQRATLINDDTDVLLVAKEQL

SEQ ID NO: 1382 - protein, 622 aa, Escherichia coli
MSTDNKQSLPAITLAAIGVVYGDIGTSPLYTLRECLSGQFGFGVERDAVFGFLSLIFWLLIFVVSIKYLTFVMRADNAGEGGILTLMSLAGRNTSARTTSMLVIMGLIGGSFFYGEVVITPAISVMSAIEGLEIVAPQLDTWIVPLSIIVLTLLFMIQKHGTAMVGKLFAPIMLTWFLILAGLGLRSIIANPEVLHALNPMWAVHFFLEYKTVSFIALGAVVLSITGVEALYADMGHFGKFPIRLAWFTVVLPSLTLNYFGQGALLLKNPEAIKNPFFLLAPDWALIPLLIIAALATVIASQAVISGVFSLTRQAVRLGYLSPMRIIHTSEMESGQIYIPFVNWMLYVAVVIVIVSFEHSSNLAAAYGIAVTGTMVLTSILSTTVARQNWHWNKYFVALILIAFLCVDIPLFTANLDKLLSGGWLPLSLGTVMFIVMTTWKSERFRLLRRMHEHGNSLEAMIASLEKSPPVRVPGTAVYMSRAINVIPFALMHNLKHNKVLHERVILLTLRTEDAPYVHNVRRVQIEQLSPTFWRVVASYGWRETPNVEEVFHRCGLEGLSCRMMETSFFMSHESLILGKRPWYLRLRGKLYLLLQRNALRAPDQFEIPPNRVIELGTQVEI

SEQ ID NO: 1383 - protein, 608 aa, Escherichia coli
MSAISLINSGVAWFVAAAVLAFLFSFQKALSGWIAGIGGAVGSLYTAAAGFTVLTGAVGVSGALSLVSYDVQISPLNAIWLITLGLCGLFVSLYNIDWHRHAQVKCNGLQINMLMAAAVCAVIASNLGMFVVMAEIMALCAVFLTSNSKEGKLWFALGRLGTLLLAIACWLLWQRYGTLDLRLLDMRMQQLPLGSDIWLLGVIGFGLLAGIIPLHGWVPQAHANASAPAAALFSTVVMKIGLLGILTLSLLGGNAPLWWGIALLVLGMITAFVGGLYALVEHNIQRLLAYHTLENIGIILLGLGAGVTGIALEQPALIALGLVGGLYHLLNHSLFKSVLFLGAGSVWFRTGHRDIEKLGGIGKKMPVISIAMLVGLMAMAALPPLNGFAGEWVIYQSFFKLSNSGAFVARLLGPLLAVGLAITGALAVMCMAKVYGVTFLGAPRTKEAENATCAPLLMSVSVVALAICCVIGGVAAPWLLPMLSAAVPLPLEPANTTVSQPMITLLLIACPLLPFIIMAICKGDRLPSRSRGAAWVCGYDHEKSMVITAHGFAMPVKQAFAPVLKLRKWLNPVSLVPGWQCEGSALLFRRMALVELAVLVVIIVSRGA

SEQ ID NO: 1384 - protein, 157 aa, Escherichia coli
MPNIVLSRIDERLIHGQVGVQWVGFAGANLVLVANDEVAEDPVQQNLMEMVLAEGIAVRFWTLQKVIDNIHRAADRQKILLVCKTPADFLTLVKGGVPVNRINVGNMHYANGKQQIAKTVSVDAGDIAAFNDLKTAGVECFVQGVPTEPAVDLFKLL

SEQ ID NO: 1385 - protein, 514 aa, Escherichia coli
MKIRSQVGMVLNLDKCIGCHTCSVTCKNVWTGREGMEYAWFNNVETKPGIGYPKNWEDQEEWQGGWVRDVNGKIRPRLGNKMGVITKIFANPVVPQIDDYYEPFTFDYEHLHSAPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEREVDLYERQCEVFLDPHDPSVIEEALKQGIPQNVIDAAQRSPVYKMAMDWKLALPLHPEYRTLPMVWYVPPLSPIQSYADAGGLPKSEGVLPAIESLRIPVQYLANMLSAGDTGPVLRALKRMMAMRHYMRSQTVEGVTDTRAIDEVGLSVAQVEEMYRYLAIANYEDRFVIPTSHREMAGDAFAERNGCGFTFGDGCHGSDSKFNLFNSSRIDAINITEVRDKAEGE

SEQ ID NO: 1386 - protein, 187 aa, Escherichia coli [sequence omitted]

SEQ ID NO: 1387 - protein, 502 aa, Escherichia coli
MAISTPMLVTFCVYIFGMILIGFIAWRSTKNFDDYILGGRSLGPFVTALSAGASDMSGWLLMGLPGAVFLSGISESWIAIGLTLGAWINWKLVAGRLRVHTEYNNNALTLPDYFTGRFEDKSRILRIISALVILLFFTIYCASGIVAGARLFESTFGMSYETALWAGAAATILYTFIGGFLAVSWTDTVQASLMIFALILTPVIVIISVGGFGDSLEVIKQKSIENVDMLKGLNFVAIISLMGWGLGYFGQPHILARFMAADSHHSIVHARRISMTWMILCLAGAVAVGFFGIAYFNDHPALAGAVNQNAERVFIELAQILFNPWIAGILLSAILAAVMSTLSCQLLVCSSAITEDLYKAFLRKHASQKELVWVGRVMVLVVALVAIALAANPENRVLGLVSYAWAGFGAAFGPVVLFSVMWSRMTRNGALAGMIIGALTVIVWKQFGWLGLYEIIPGFIFGSIGIVVFSLLGKAPSAAMQKRFAEADAHYHSAPPSRLQES

SEQ ID NO: 1388 - protein, 537 aa, Escherichia coli
MKHSVSVTCCALLVSSISLSYAAEVPSGTVLAEKQELVRHIKDEPASLDPAKAVGLPEIQVIRDLFEGLVNQNEKGEIVPGVATQWKSNDNRIWTFTLRDNAKWADGTPVTAQDFVYSWQRLVDPKTLSPFAWFAALAGINNAQAIIDGKATPDQLGVTAVDAHTLKIQLDKPLPWFVNLTANFAFFPVQKANVESGKEWTKPGNLIGNGAYVLKERVVNEKLVVVPNTHYWDNAKTVLQKVTFLPINQESAATKRYLAGDIDITESFPKNMYQKLLKDIPGQVYTPPQLGTYYYAFNTQKGPTADQRVRLALSMTIDRRLMTEKVLGTGEKPAWHFTPDVTAGFTPEPSPFEQMSQEELNAQAKTLLSAAGYGPQKPLKLTLLYNTSENHQKIAIAVASMWKKNLGVDVKLQNQEWKTYIDSRNTGNFDVIRASWVGDYNEPSTFLTLLTSTHSGNISRFNNPAYDKVLAQASTENTVKARNADYNAAEKILMEQAPIAPIYQYTNGRLIKPWLKGYPINNPEDVAYSRTMYIVKH

SEQ ID NO: 1389 - protein, 100 aa, Escherichia coli
MIPLQHGLILAAILFVLGLTGLVIRRNLLFMLIGLEIMINASALAFVVAGSYWGQTDGQVMYILAISLAAAEASIGLALLLQLHRRRQNLNIDSVSEMRG

SEQ ID NO: 1390 - protein, 911 aa, Escherichia coli
MTHLELVPVPPVAQLAGVSQHYGKTVALNNITLDIPARCMVGLIGPDGVGKSSLLSLISGARVIEQGNVMVLGGDMRDPKHRRDVCPRIAWMPQGLGKNLYHTLSVYENVDFFARLFGHDKAEREVRINELLTSTGLAPFRDRPAGKLSGGMKQKLGLCCALIHDPELLILDEPTTGVDPLSRSQFWDLIDSIRQRQSNMSVLVATAYMEEAERFDWLVAMNAGEVLATGSAEELRQQTQSATLEEAFINLLPQAQRQAHQAVVIPPYQPENAEIAIEARDLTMRFGSFVAVDHVNFRIPRGEIFGFLGSNGCGKSTTMKMLTGLLPASEGEAWLFGQPVDPKDIDTRRRVGYMSQAFSLYNELTVRQNLELHARLFHIPEAEIPARVAEMSERFKLNDVEDILPESLPLGIRQRLSLAVAVIHRPEMLILDEPTSGVDPVARDMFWQLMVDLSRQDKVTIFISTHFMNEAERCDRISLMHAGKVLASGTPQELVEKRGAASLEEAFIAYLQEAAGQSNEAEAPPVVHDTTHAPRQGFSLRRLFSYSRREALELRRDPVRSTLALMGTVILMLIMGYGISMDVENLRFAVLDRDQTVSSQAWTLNLSGSRYFIEQPPLTSYDELDRRMRAGDITVAIEIPPNFGRDIARGTPVELGVWIDGAMPSRAETVKGYVQAMHQSWLQDVASRQSTPASQSGLMNIETRYRYNPDVKSLPAIVPAVIPLLLMMIPSMLSALSVVREKELGSIINLYVTPTTRSEFLLGKQLPYIALGMLNFFLLCGLSVFVFGVPHKGSFLTLTLAALLYIIIATGMGLLISTFMKSQIAAIFGTAIITLIPATQFSGMIDPVASLEGPGRWIGEVYPTSHFLTIARGTFSKALDLTDLWQLFIPLLIAIPLVMGLSILLLKKQEG

SEQ ID NO: 1391 - protein, 203 aa, Escherichia coli
MNRFVIADSTLCIGCHTCEAACSETHRQHGLQSMPRLRVMLNEKESAPQLCHHCEDAPCAVVCPVNAITRVDGAVQLNESLCVSCKLCGIACPFGAIEFSGSRPLDIPANANTPKAPPAPPAPARVSTLLDWVPGIRAIAVKCDLCSFDEQGPACVRMCPTKALHLVDNTDIARVSKRKRELTFNTDFGDLTLFQQAQSGEAK

SEQ ID NO: 1392 - protein, 147 aa, Escherichia coli
MADITLISGSTLGGAEYVAEHLAEKLEEAGFTTETLHGPLLEDLPASGIWLVISSTHGAGDIPDNLSPFYEALQEQKPDLSAVRFGAIGIGSREYDTFCGAIDKLEAELKNSGAKQTGETLKINILDHDIPEDPAEEWLGSWVNLLK

SEQ ID NO: 1393 - protein, 512 aa, Escherichia coli
MAFASLIERQRIRLLLALLFGACGTLAFSPYDVWPAAIISLMGLQALTFNRRPLQSAAIGFCWGFGLFGSGINWVYVSIATFGGMPGPVNIFLVVLLAAYLSLYTGLFAGVLSRLWPKTTWLRVAIAAPALWQVTEFLRGWVLTGFPWLQFGYSQIDGPLKGLAPIMGVEAINFLLMMVSGLLALALVKRNWRPLVVAVVLFALPFPLRYIQWFTPQPEKTIQVSMVQGDIPQSLKWDEGQLLNTLKIYYNATAPLMGKSSLIIWPESAITDLEINQQPFLKALDGELRDKGSSLVTGIVDARLNKQNRYDTYNTIITLGKGAPYSYESADRYNKNHLVPFGEFVPLESILRPLAPFFDLPMSSFSRGPYIQPPLSANGIELTAAICYEIILGEQVRDNFRPDTDYLLTISNDAWFGKSIGPWQHFQMARMRALELARPLLRSTNNGITAVIGPQGEIQAMIPQFTREVLTTNVTPTTGLTPYARTGNWPLWVLTALFGFAAVLMSLRQRRK

SEQ ID NO: 1394 - protein, 87 aa, Escherichia coli
MHTNWQVCSLVVQAKSERISDISTQLNAFPGCEVAVSDAPSGQLIVVVEAEDSETLIQTIESVRNVEGVLAVSLVYHQQEEQGEETP

SEQ ID NO: 1395 - protein, 241 aa, Escherichia coli
MHLSTHPTSYPTRYQEIAAKLEQELRQHYRCGDYLPAEQQLAARFEVNRHTLRRAIDQLVEKGWVQRRQGVGVLVLMRPFDYPLNAQARFSQNLLDQGSHPTSEKLLSVLRPASGHVADALGITEGENVIHLRTLRRVNGVALCLIDHYFADLTLWPTLQRFDSGSLHDFLREQTGIALRRSQTRISARRAQAKECQRLEIPNMSPLLCVRTLNHRDGESSPAEYSVSLTRADMIEFTMEH

SEQ ID NO: 1396 - protein, 478 aa, Escherichia coli
MTRIKINARRIFSLLIPFFFFTSVHAEQTAAPAKPVTVEAKNETFAPQHPDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 1397 - protein, 334 aa, Escherichia coli
MNAVTEGRKVLLEIADLKVHFEIKDGKQWFWQPPKTLKAVDGVTLRLYEGETLGVVGESGCGKSTFARAIIGLVKATDGHVAWLGKELLGMKPDEWRAVRSDIQMIFQDPLASLNPRMTIGEIIAEPLRTYHPKMSRQEVRERVKAMMLKVGLLPNLINRYPHEFSGGQCQRIGIARALILEPKLIICDEPVSALDVSIQAQVVNLLQQLQREMGLSLIFIAHDLAVVKHISDRVLVMYLGHAVELGTYDEVYHNPLHPYTRALMSAVPIPDPDLEKNKTIQLLEGELPSPINPPSGCVFRTRCPIAGPECAKTRPVLEGSFRHSVSCLKVDPL

SEQ ID NO: 1398 - protein, 352 aa, Escherichia coli
MLELNFSQTLGNHCLTINETLPANGITAIFGVSGAGKTSLINAISGLTRPQKGRIVLNGRVLNDAEKGICLTPEKRRVGYVFQDARLFPHYKVRGNLRYGMSKSMVDQFDKLVALLGIEPLLDRLPGSLSGGEKQRVAIGRALLTAPELLLLDEPLASLDIPRKRELLPYLQRLTREINIPMLYVSHSLDEILHLADRVMVLENGQVKAFGALEEVWGSSVMNPWLPKEQQSSILKVTVLEHHPHYAMTALALGDQHLWVNKLDEPLQAALRIRIQASDVSLVLQPPQQTSIRNVLRAKVVNSYDDNGQVEVELEVGGKTLWARISPWARDELAIKPGLWLYAQIKSVSITA

SEQ ID NO: 1399 - protein, 156 aa, Escherichia coli
MNLNATILGQAIAFVLFVLFCMKYVWPPLMAAIEKRQKEIADGLASAERAHKDLDLAKASATDQLKKAKAEAQVIIEQANKRRSQILDEAKAEAEQERTKIVAQAQAEIEAERKRAREELRKQVAILAVAGAEKIIERSVDEAANSDIVDKLVAEL

SEQ ID NO: 1400 - protein, 387 aa, Escherichia coli
MEQINSNKKHSNRRKYFSLLAVVLFIAFSGAYAYWSMELEDMISTDDAYVTGNADPISAQVSGSVTVVNHKDTNYVRQGDILVSLDKTDATIALNKAKNNLANIVRQTNKLYLQDKQYSAEVASARIQYQQSLEDYNRRVPLAKQGVISKETLEHTKDTLISSKAALNAAIQAYKANKALVMNTPLNRQPQVVEAADATKEAWLALKRTDIKSPVTGYIAQRSVQVGETVSPGQSLMAVVPARQMWVNANFKETQLTDVRIGQSVNIISDLYGENVVFHGRVTGINMGTGNAFSLLPAQNATGNWIKIVQRVPVEVSLDPKELMEHPLRIGLSMTATIDTKNEDIAEMPELASTVTSMPAYTSKALVIDTSPIEKEISNIISHNGQL

SEQ ID NO: 1401 - protein, 732 aa, Escherichia coli
MSKLKIAVSDSCPDCFTTQRECIYINESRNIDVAAIVLSLNDVTCGKLDEIDATGYGIPVFIATENQERVPAEYLPRISGVFENCESRREFYGRQLETAASHYETQLRPPFFRALVDYVNQGNSAFDCPGHQGGEFFRRHPAGNQFVEYFGEALFRADLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELIAEVAPQRAKEARPFRLAVIQLGTYDGTIYNARQVVDKIGHLCDYILFDSAWVGYEQFIPMMADCSPLLLDLNENDPGILVTQSVHKQQAGFSQTSQIHKKDSHIKGQQRYVPHKRMNNAFMMHASTSPFYPLFAALNINAKMHEGVSGRNMWMDCVVNGINARKLILDNCQHIRPFVPELVDGKPWQSYETAQIAVDLRFFQFVPGEHWHSFEGYAENQYFVDPCKLLLTTPGIDARNGEYEAFGVPATILANFLRENGVVPEKCDLNSILFLLTPAEDMAKLQQLVALLVRFEKLLESDAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 1402 - protein, 393 aa, Escherichia coli
MTCSTSLSGKNRIVLIAGILMIATTLRVTFTGAAPLLDTIRSAYSLTTAQTGLLTTLPLLAFALISPLAAPVARRFGMERSLFAALLLICAGIAIRSLPSPYLLFGGTAVIGGGIALGNVLLPGLIKRDFPHSVARLTGAYSLTMGAAAALGSAMVVPLALNGFGWQGALLMLMCFPLLALFLWLPQWRSQQHANLSTSRALHTRGIWRSPLAWQVTLFLGINSLVYYVIIGWLPAILISHGYSEAQAGSLHGLLQLATAAPGLLIPLFLHHVKDQRGIAAFVALMCAVGAVGLCFMPAHAITWTLLFGFGSGATMILGLTFIGLRASSAHQAAALSGMAQSVGYLLAACGPPLMGKIHDANGNWSVPLMGVAILSLLMAIFGLCAGRDKEIR

SEQ ID NO: 1403 - protein, 262 aa, Escherichia coli
MQAEILLTLKLQQKLFADPRRISLLKHIALSGSISQGAKDAGISYKSAWDAINEMNQLSEHILVERATGGKGGGGAVLTRYGQRLIQLYDLLAQIQQKAFDVLSDDDALPLNSLLAAISRFSLQTSARNQWFGTITARDHDDVQQHVDVLLADGKTRLKVAITAQSGARLGLDEGKEVLILLKAPWVGITQDEAVAQNADNQLPGIISHIERGAEQCEVLMALPDGQTLCATVPVNEATSLQQGQNVTAYFNADSVIIATLC

SEQ ID NO: 1404 - protein, 543 aa, Escherichia coli
MTNITKRSLVAAGVLAALMAGNVALAADVPAGVTLAEKQTLVRNNGSEVQSLDPHKIEGVPESNISRDLFEGLLVSDLDGHPAPGVAESWDNKDAKVWTFHLRKDAKWSDGTPVTAQDFVYSWQRSVDPNTASPYASYLQYGHIAGIDEILEGKKPITDLGVKAIDDHTLEVTLSEPVPYFYKLLVHPSTSPVPKAAIEKFGEKWTQPGNIVTNGAYTLKDWVVNERIVLERSPTYWNNAKTVINQVTYLPIASEVTDVNRYRSGEIDMTNNSMPIELFQKLKKEIPDEVHVDPYLCTYYYEINNQKPPFNDVRVRTALKLGMDRDIIVNKVKAQGNMPAYGYTPPYTDGAKLTQPEWFGWSQEKRNEEAKKLLAEAGYTADKPLTINLLYNTSDLHKKLAIAASSLWKKNIGVNVKLVNQEWKTFLDTRHQGTFDVARAGWCADYNEPTSFLNTMLSNSSMNTAHYKSPAFDSIMAETLKVTDEAQRTALYTKAEQQLDKDSAIVPVYYYVNARLVKPWVGGYTGKDPLDNTYTRNMYIVKH

SEQ ID NO: 1405 - protein, 300 aa, Escherichia coli
MSQVTENKVISAPVPMTPLQEFWHYFKRNKGAVVGLVYVVIVLFIAIFANWIAPYNPAEQFRDALLAPPAWQEGGSMAHLLGTDDVGRDVLSRLMYGARLSLLVGCLVVVLSLIMGVILGLIAGYFGGLVDNIIMRVVDIMLALPSLLLALVLVAIFGPSIGNAALALTFVALPHYVRLTRAAVLVEVNRDYVTASRVAGAGAMRQMFINIFPNCLAPLIVQASLGFSNAILDMAALGFLGMGAQPPTPEWGTMLSDVLQFAQSAWWVVTFPGLAILLTVLAFNLMGDGLRDALDPKLKQ

SEQ ID NO: 1406 - protein, 511 aa, Escherichia coli
MQTSDTRALPLLCARSVYKQYSGVNVLKGIDFTLHQGEVHALLGGNGAGKSTLMKIIAGITPADSGTLEIEGNNYVRLTPVHAHQLGIYLVPQEPLLFPSLSIKENILFGLAKKQLSMQKMKNLLAALGCQFDLHSLAGSLDVADRQMVEILRGLMRDSRILILDEPTASLTPAETERLFSRLQELLATGVGIVFISHKLPEIRQIADRISVMRDGTIALSGKTSELSTDDIIQAITPAVREKSLSASQKLWLELPGNRPQHAAGTPVLTLENLTGEGFRNVSLTLNAGEILGLAGLVGAGRTELAETLYGLRTLRGGRIMLNGKEINKLSTGERLLRGLVYLPEDRQSSGLNLDASLAWNVCALTHNLRGFWAKTAKDNATLERYRRALNIKFNQPEQAARTLSGGNQQKILIAKCLEASPQVLIVDEPTRGVDVSARNDIYQLLRSIAAQNVAVLLISSDLEEIELMADRVYVMHQGEITHSALTERDINVETIMRVAFGDSQRQEASC

SEQ ID NO: 1407 - protein, 400 aa, Escherichia coli
MAIKLEIKNLYKIFGEHPQRAFKYIEQGLSKEQILEKTGLSLGVKDASLAIEEGEIFVIMGLSGSGKSTMVRLLNRLIEPTRGQVLIDGVDIAKISDAELREVRRKKIAMVFQSFALMPHMTVLDNTAFGMELAGINAEERREKALDALRQVGLENYAHSYPDELSGGMRQRVGLARALAINPDILLMDEAFSALDPLIRTEMQDELVKLQAKHQRTIVFISHDLDEAMRIGDRIAIMQNGEVVQVGTPDEILNNPANDYVRTFFRGVDISQVFSAKDIARRTPNGLIRKTPGFGPRSALKLLQDEDREYGYVIERGNKFVGAVSIDSLKTALTQQQGLDAALIDAPLAVDAQTPLSELLSHVGQAPCAVPVVDEDQQYVGIISKGMLLRALDREGVNNG

SEQ ID NO: 1408 - protein, 378 aa, Escherichia coli
MGQSKKLNKQPSSLSPLVQLAGIRKCFDGKEVIPQLDLTINNGEFLTLLGPSGCGKTTVLRLIAGLETVDSGRIMLDNEDITHVPAENRYVNTVFQSYALFPHMTVFENVAFGLRMQKTPAAEITPRVMEALRMVQLETFAQRKPHQLSGGQQQRVAIARAVVNKPRLLLLDESLSALDYKLRKQMQNELKALQRKLGITFVFVTHDQEEALTMSDRIVVMRDGRIEQDGTPREIYEEPKNLFVAGFIGEINMFNATVIERLDEQRVRANVEGRECNIYVNFAVEPGQKLHVLLRPEDLRVEEINDDNHAEGLIGYVRERNYKGMTLESVVELENGKMVMVSEFFNEDDPDFDHSLDQKMAINWVESWEVVLADEEHK

SEQ ID NO: 1409 - protein, 276 aa, Escherichia coli
  MISC_FEATURE (34)...(34): Xaa is any amino acid
MFVPFLIMLREGLEAALIVSLIASYLKRTQRGMXDCVMWIGVLLAAALCLGLGIFINETTGEFPQKEQELFEGIVAVIAVVILTWMVFWMRKVSRNVKVQLEQAVDSALQRGNHHGWALVMMVFFAVAREGLESVFFLLAAFQQDVGIWPPLGAMLGLATAVVLGFLLYWGGIRLNLGAFFKWTSLFILFVAAGLAAGAIRAFHEAGLWNHFQEIAFDMSAVLSTHSLFGTLMEGIFGYQEAPSVSEVAVWFIYLIPALVAFALPPRAGATASRSA

SEQ ID NO: 1410 - protein, 439 aa, Escherichia coli
MPLIIIAAGVALLLILMIGFKVNGFIALVLVAAVVGFAEGMDAQAVLHSIQNGIGSTLGGLAMILGFGAMLGKLISDTGAAQRIATTLIATFGKKRVQWALVITGLVVGLAMFFEVGFVLLLPLVFTIVASSGLPLLYVGVPMVAALSVTHCFLPPHPGPTAIATIFEANLGTTLLYGFIITIPTVIVAGPLFSKLLTRFEKAPPEGLFNPHLFSEEEMPSFWNSIFAAVIPVILMAIAAVCEITLPKTNTVRLFFEFVGNPAVALFIAIVIAIFTLGRRNGRTIEQIMDIIGDSIGAIAMIVFIIAGGGAFKQVLVDSGVGHYISHLMTGTTLSPLLMCWTVAALLRIALGSATVAAITTAGVVLPIINVTHADPALMVLATGAGSVIASHVNDPGFWLFKGYFNLTVGETLRTWTVMETLISIMGLLGVLAINAVLH

SEQ ID NO: 1411 - protein, 682 aa, Escherichia coli
MSRKQLALFEPTLVVQALKEAVKKLNPQAQWRNPVMFIVWIGSLLTTCISIAMASGAMPGNALFSAAISGWLWITVLFANFAEALAEGRSKAQANSLKGVKKTAFARKLREPKYGAAADKVPADQLRKGDIVLVEAGDIIPCDGEVIEGGASVDESAITGESAPVIRESGGDFASVTGGTRILSDWLVIECSVNPGETFLDRMIAMVEGAQRRKTPNEIALTILLIALTIVFLLATATLWPFSAWGGNAVSVTVLVALLVCLIPTTIGGLLSAIGVAGMSRMLGANVIATSGRAVEAAGDVDVLLLDKTGTITLGNRQASEFIPAQGVDEKTLADAAQLASLADETPEGRSIVILAKQRFNLRERDVQSLHATFVPFTAQSRMSGINIDNRMIRKGSVDAIRRHVEANGGHFPTDVDQKVDQVARQGATPLVVVEGSRVLGVIALKDIVKGGIKERFAQLRKMGIKTVMITGDNRLTAAAIAAEAGVDDFLAEATPEAKLALIRQYQAEGRLVAMTGDGTNDAPALAQADVAVAMNSGTQAAKEAGNMVDLDSNPTKLIEVVHIGKQMLMTRGSLTTFSIANDVAKYFAIIPAAFAATYPQLNALNIMCLHSPDSAILSAVIFNALIIVFLIPLALKGVSYKPLTASAMLRRNLWIYGLGGLLVPFIGIKVIDLLLTVCGLV

SEQ ID NO: 1412 - protein, 371 aa, Escherichia coli
MKKRKTVKKRYVIALVIVIAGLITLWRILNAPVPTYQTLIVRPGDLQQSVLATGKLDALRKVDVGAQVSGQLKTLSVAIGDKVKKDQLLGVIDPEQAENQIKEVEATLMELRAQRQQAEAELKLARVTYSRQQRLAQTKAVSQQDLDTAATEMAVKQAQIGTIDAQIKRNQASLDTAKTNLDYTRIVAPMAGEVTQITTLQGQTVIAAQQAPNILTLADMSAMLVKAQVSEADVIHLKPGQKAWFTVLGDPLTRYEGQIKDVLPTPEKVNDAIFYYARFEVPNPNGLLRLDMTAQVHIQLTDVKNVLTIPLSALGDPVGDNRYKVKLLRNGETREREVTIGARNDTDVEIVKGLEAGDEVVIGEAKPGAAQ

SEQ ID NO: 1413 - protein, 176 aa, Escherichia coli
MRNKPFYLLCAFLWLAVSHALAADSTITIRGYVRDNGCSVAAESTNFTVDLMENAAKQFNNIGATTPVVPFRILLSPCGNAVSAVKVGFTGVADSHNANLLALENTVSAASGLGIQLLNEQQNQIPLNAPSSALSWTTLTPGKPNTLNFYARLMATQVPVTAGHINATATFTLEYQ

SEQ ID NO: 1414 - protein, 148 aa, Escherichia coli
MTDNNTALKKAGLKVTLPRLKILEVLQEPDNHHVSAEDLYKRLIDMGEEIGLATVYRVLNQFDDAGIVTRHNFEGGKSVFELTQQHHHDHLICLDCGKVIEFSDDSIEARQREIAAKHGIRLTNHSLYLYGHCAEGDCREDEHAHEGK

SEQ ID NO: 1415 - protein, 228 aa, Escherichia coli
MLYGFSGVILQGALVTLELAISSVVLAVIIGLIGAGGKLSQNRLSGLIFEGYTTLIRGVPDLVLMLLIFYGLQIALNTVTEAMGVGQIDIDPMVAGIITLGFIYGAYFTETFRGAFMAVPKGHIEAATAFGFTRGQVFRRIMFPSMMRYALPGIGNNWQVILKSTALVSLLGLEDVVKATQLAGKSTWEPFYFAIVCGVIYLVFTTVSNGVLLFLERRYSVGVKRADL

SEQ ID NO: 1416 - protein, 461 aa, Escherichia coli
MNIPQLTALCLRYHGVLLDASEEVVHVAVVDAPSHELLDALHFATTKRIEITCWTRQQMEGHASRTQQTLPVAVQEKHQPKAELLTRTLQSALEQRASDIHIEPADNAYRIRLRIDGVLHPLPDVSPDAGVALTARLKVLGNLDIAEHRLPQDGQFTVELAGNAVSFRIATLPCRGGEKVVLRLLQQVGQALDVNTLGMQPLQLADFAHALQQPQGLVLVTGPTGSGKTVTLYSALQKLNTADINICSVEDPVEIPIAGLNQTQIHPRAGLTFQGVLRALLRQDPDVIMIGEIRDGETAEIAIKAAQTGHLVLSTLHTNSTCETLVRLQQMGVARWMLSSALTLVIAQRLVRKLCPHCRRQQGEPIHIPDNVWPSPLPHWQAPGCVHCYHGFYGRTALFEVLPITPVIRQLISANTDVESLETHARQAGMRTLFENGCLAVEQGLTTFEELIRVLGMPHGE

SEQ ID NO: 1417 - protein, 330 aa, Escherichia coli
MRHSVLFATAFATLISTQTFAADLPGKGITVNPVQSTITEETFQTLLVSRALEKLGYTVNKPSEVDYNVGYTSLASGDATFTAVNWTPLHDNMYEAAGGDKKFYREGVFVNGAAQGYLIDKKTADQYKITNIAQLKDPKIAKLFDTNGDGKADLTGCNPGWGCEGAINHQLAAYELTNTVTHNQGNYAAMMADTISRYKEGKPVFYYTWTPYWVSNELKPGKDVVWLQVPFSALPGDKNADTKLPNGANYGFPVSTMHIVANKAWAEKNPAAAKLFAIMQLPVADINAQNAIMHDGKASEGDIQGHVDGWIKAHQQQFDGWVNEALAAQK

SEQ ID NO: 1418 - protein, 496 aa, Escherichia coli
MSTTTQNIPWYRHLNRAQWRAFSAAWLGYLLDGFDFVLIALVLTEVQGEFGLTTVQAASLISAAFISRWFGGLMLGAMGDRYGRRLAMVTSIVLFSAGTLACGFAPGYITMFIARLVIGMGMAGEYGSSATYVIESWPKHLRNKASGFLISGFSVGAVVAAQVYSLVVPVWGWRALFFIGILPIIFALWLRKNIPEAEDWKEKHAGKAPVRTMVDILYRGEHRIANIVMTLAAATALWFCFAGNLQNAAIVAVLGLLCAAIFISFMVQSAGKRWPTGVMLMVVVLFAFLYSWPIQALLPTYLKTDLAYNPHTVANVLFFSGFGAAVGCCVGGFLGDWLGTRKAYVCSLLASQLLIIPVFAIGGANVWVLGLLLFFQQMLGQGIAGILPKLIGGYFDTDQRAAGLGFTYNVGALGGALAPIIGALIAQRLDLGTALASLSFSLTFVVILLIGLDMPSRVQRWLRPEALRTHDAIDGKPFSGAVPFGSAKNDLVKTKS

SEQ ID NO: 1419 - protein, 314 aa, Escherichia coli
MLRYVLRRFLLLIPMVLAASVIIFLMLRLGTGDPALDYLRLSNLPPTPEMLASTRTMLGLDQPLYVQYGTWLWKALHLDFGISFASQRPVLDDMLNFLPATLELAGAALVLILLTSVPLGIWAARHRDRLPDFAVRFIAFLGVSMPNFWLAFLLVMAFSVYLQWLPAMGYGGWQHIILPAVSIAFMSLAINARLLRASMLDVAGQRHVTWARLRGLNDKQTERRHILRNASLPMITAVGMHIGELIGGTMIIENIFAWPGVGRYAVSAIFNRDYPVIQCFTLMMVVVFVVCNLIVDLLNAALDPRIRRHEGAHA

SEQ ID NO: 1420 - protein, 188 aa, Escherichia coli
MNITATVLLAFGMSMDAFAASIGKGATLHKPKFSEALRTGLIFGAVETLTPLIGWGMGMLASRFVLEWNHWIAFVLLIFLGGRMIIEGFRGADDEDEEPRRRHGFWLLVTTAIATSLDAMAVGVGLAFLQVNIIATALAIGCATLIMSTLGMMVGRFIGSIIGKKAEILGGLVLIGIGVQILWTHFHG

SEQ ID NO: 1421 - protein, 167 aa, Escherichia coli
MKWCKRGYVLAAILALASATIQAADVTITVNGKVVAKPCTVSTTNATVDLGDLYSFSLMSAGAASAWHDVALELTNCPVGTSRVTASFSGAADSTGYYKNQGTAQNIQLELQDDSGNTLNTGATKTVQVDDSSQSAHFPLQVRALTVNGGATQGTIQAVISITYTYS

SEQ ID NO: 1422 - protein, 391 aa, Escherichia coli
MSRFLICSFALVLLYPAGIDMYLVGLPRIAADLNASEAQLHIAFSVYLAGMAAAMLFAGKVADRSGRKPVAIPGAALFIIASVFCSLAETSTLFLAGRFLQGLGAGCCYVVAFAILRDTLDDRRRAKVLSLLNGITCIIPVLAPVLGHLIMLKFPWQSLFWAMAMMGIAVLMLSLFILKETRPAAPAASDKPRENSESLLNRFFLSRVVITTLSVSVILTFVNTSPVLLMEIMGFERGEYATIMALTAGVSMTVSFSTPFALGIFKPRTLMITSQVLFLAAGITLAVSPSHAVSLFGITLICAGFSVGFGVAMSQALGPFSLRAGVASSTLGIAQVCGSSLWIWLAAVVGIGAWNMLIGILIACSIVSLLLIMFVAPGRPVAAHEEIHHHA

SEQ ID NO: 1423 - protein, 1040 aa, Escherichia coli
MQVLPPSSTGGPSRLFIMRPVATTLLMVAILLAGIIGYRALPVSALPEVDYPTIQVVTLYPGASPDVMTSAVTAPLERQFGQMSGLKQMSSQSSGGASVITLQFQLTLPLDVAEQEVQAAINAATNLLPSDLPNPPVYSKVNPADPPIMTLAVTSTAMPMTQVEDMVETRVAQKISQISGVGLVTLSGGQRPAVRVKLNAQAIAALGLTSETVRTAITGANVNSAKGSLDGPSRAVTLSANDQMQSAEEYRQLIIAYQNGAPIRLGDVATVEQGAENSWLGAWANKEQAIVMNVQRQPGANIISTADSIRQMLPQLTESLPKSVKVTVLSDRTTNIRASVDDTQFELMMAIALVVMIIYLFLRNIPATIIPGVAVPLSLIGTFAVMVFLDFSINNLTLMALTIATGFVVDDAIVVIENISRYIEKGEKPLAAALKGAGEIGFTIISLTFSLIAVLIPLLFMGDIVGRLFREFAITLAVAILISAVVSLTLTPMMCARMLSQESLRKQNRFSRASEKMFDRIIAAYGRGLAKVLNHPWLTLSVALSTLLLSVLLWVFIPKGFFPVQDNGIIQGTLQAPQSSSFANMAQRQRQVADVILQDPAVQSLTSFVGVDGTNPSLNSARLQINLKPLDERDDRVQKVIARLQTAVDKVPGVDLFLQPTQDLTIDTQVSRTQYQFTLQATSLDALSTWVPQLMEKLQQLPQLSDVSSDWQDKGLVAYVNVDRDSASRLGISMADVDNALYNAFGQRLISTIYTQANQYRVVLEHNTENTPGLAALDTIRLTSSDGGVVPLSSIAKIEQRFAPLSINHLDQFPVTTISFNVPDNYSLGDAVQAIMDTEKTLNLPVDITTQFQGSTLAFQSALGSTVWLIVAAVVAMYIVLGILYESFIHPITILSTLPTAGVGALLALLIAGSELDVIAIIGIILLIGIVKKNAIMMIDFALAAEREQGMSPREAIYQACLLRFRPILMTTLAALLGALPLMLSTGVGAELRRPLGIGMVGGLIVSQVLTLFTTPVIYLLFDRLALWTKSRFARHEEEA

SEQ ID NO: 1424 - protein, 784 aa, Escherichia coli
MKKRIPTLLATMIATALYSQQGLAADLASQCMLGVPSYDRPLVQGDTNDLPVTINADHAKGDYPDDAVFTGSVDIMQGNSRLQADEVQLHQKEAPGQPEPVRTVDALGNVHYDDNQVILKGPKGWANLNTKDTNVWEGDYQMVGRQGRGKADLMKQRGENRYTILDNGSFTSCLPGSDTWSVVGSEIIHDREEQVAEIWNARFKVGPVPIFYSPYLQLPVGDKRRSGFLIPNAKYTTTNYFEFYLPYYWNIAPNMDATITPHYMHRRGNIMWENEFRYLSQAGAGLMELDYLPSDKVYEDEHPNDDSSRRWLFYWNHSGVMDQVWRFNVDYTKVSDPSYFNDFDNKYGSSTDGYATQKFSVGYAVQNFNATVSTKQFQVFSEQNTSSYSAEPQLDVNYYQNDVGPFDTRIYGQAVHFVNTRDDMPEATRVHLEPTINLPLSNNWGSINTEAKLLATHYQQTNLDWYNSRNTTKLDESVNRVMPQFKVDGKMVFERDMEMLAPGYTQTLEPRAQYLYVPYRDQSDIYNYDSSLLQSDYSGLFRDRTYGGLDRIASANQVTTGVTSRIYDDAAVERFNISVGQIYYFTESRTGDDNITWENDDKTGSLVWAGDTYWRISERWGLRGGIQYDTRLDNVATSNSSIEYRRDEDRLVQLNYRYASPEYIQATLPKYYSTAEQYKNGISQVGAVASWPIADRWSIVGAYYYDTNANKQADSMLGVQYSSCCYAIRVGYERKLNGWDNDKQHAVYDNAIGFNIELRGLSSNYGLGTQEMLRSNILPYQNTL

SEQ ID NO: 1425 - protein, 512 aa, Escherichia coli
MARAVHRSGLVALGIATALMASCAFAAKDVVVAVGSNFTTLDPYDANDTLSQAVAKSFYQGLFGLDKEMKLKNVLAESYTVSDDGITYTVKLREGIKFQDGTDFNAAAVKANLDRASDPANHLKRYNLYKNIAKTEAIDPTTVKITLKQPFSAFINILAHPATAMISPAALEKYGKEIGFYPVGTGPYELDTWNQTDFVKVKKFAGYWQPGLPKLDSITWRPVADNNTRAAMLQTGEAQFAFPIPYEQATLLEKNKNIELMASPSIMQRYISMNVTQKPFDNPKVREALNYAINRPALVKVAFAGYATPATGVVPPSIAYAQSYKPWPYDPVKARELLKEAGYPNGFSTTLWSSHNHSTAQKVLQFTQQQLAQVGIKAQVTAMDAGQRAAEVEGKGQKESGVRMFYTGWSASTGEADWALSPLFASQNWPPTLFNTAFYSNKQVDDFLAQALKTNDPAEKTRLYKAAQDIIWQESPWIPLVVEKLVSAHSKNLTGFWIMPDTGFSFEDADLQ

SEQ ID NO: 1426 - protein, 176 aa, Escherichia coli
MLRFLNQCSQGRGAWLLMAFTALALELTALWFQHVMLLKPCVLCIYERCALFGVLGAALIGAIAPKTPLRYVAMVIWLYSAFRGVQLTYEHTMLQLYPSPFATCDFMVRFPEWLPLDKWVPQVFVASGDCAERQWDFLGLEMPQWLLGIFIAYLIVAVLVVISQPFKAKKRDLFGR

SEQ ID NO: 1427 - protein, 252 aa, Escherichia coli
METRREERIGQLLQELKRSDKLHLKDAAALLGVSEMTIRRDLNNHSAPVVLLGGYIVLEPRSASHYLLSDQKSRLVEEKRRAAKLAATLVEPDQTLFFDCGTTTPWIIEAIDNEIPFTAVCYSLNTFLALKEKPHCRAFLCGGEFHASNAIFKPIDFQQTLNNFCPDIAFYSAAGVHVSKGATCFNLEELPVKHWAMSMAQKHVLVVDHSKFGKVRPARMGDLKRFDIVVSDCCPEDEYVKYAQTQRIKLMY

SEQ ID NO: 1428 - protein, 306 aa, Escherichia coli
MLNYVIKRLLGLIPTLFIVSVLVFLFVHMLPGDPARLIAGPEADAQVIELVRQQLGLDQPLYHQFWHYISNAVQGDFGLSMVSRRPVADEIASRFMPTLWLTITSMVWAVIFGMAAGIIAAVWRNRWPDRLSMTIAVSGISFPAFALGMLLIQVFSVELGWLPTVGADSWQHYILPSLTLGAAVAAVMARFTRASFVDVLSEDYMRTARAKGVSETWVVLKHGLRNAMIPVVTMMGLQFGFLLGGSIVVEKVFNWPGLGRLLVDSVEMRDYPVIQAEILLFSLEFILINLVVDVLYAAINPAIRYK

SEQ ID NO: 1429 - protein, 407 aa, Escherichia coli
MQTQLTEEMRQNARALEADSILRACVHCGFCTATCPTYQLLGDELDGPRGRIYLIKQVLEGNEVTLKTQEHLDRCLTCRNCETTCPSGVRYHNLLDIGRDIVEQKVKRPLPERILREGLRQVVPRPAVFRALTQVGLVLRPFLPEQVRAKLPAETVKAKPRPPLRHKRRVLMLEGCAQPTLSPNTNAATARVLDRLGISVMPANEAGCCGAVDYHLNAQEKGLARARNNIDAWWPAIEAGAEAILQTASGCGAFVKEYGQMLKNDALYADKARQVSELAVDLVELLREEPLEKLAIRGDKKLAFHCPCTLQHAQKLNGEVEKVLLRLGFTLTDVPDSHLCCGSAGTYALTHPDLARQLRDNKMNALESGKPEMIVTANIGCQTHLASAGRTSVRHWIEIVEQALEKE

SEQ ID NO: 1430 - protein, 650 aa, Escherichia coli
MKGLNKITCCLLAALLMPCAGHAENEQYGANFNNADIRQFVEIVGQHLGKTILIDPSVQGTISVRSNDTFSQQEYYQFFLSILDLYGYSVITLDNGFLKVVRSANVKTSPGMIADSSRPGVGDELVTRIVPLENVPARDLAPLLRQMMDAGSVGNVVHYEPSNVLILTGRASTINKLIEVIKRVDVIGTEKQQIIHLEYASAEDLAEILNQLISESHGKSQMPALLSAKIVADKRTNSLIISGPEKARQRITSLLKSLDVEESEEGNTRVYYLKYAKATNLVEVLTGVSEKLKDEKGNARKPSSSGAMDNVAITADEQTNSLVITADQSVQEKLATVIARLDIRRAQVLVEAIIVEVQDGNGLNLGVQWANKNVGAQQFTNTGLPIFNAAQGVADYKKNGGITSANPAWDMFSAYNGMAAGFFNGDWGVLLTALASNNKNDILATPSIVTLDNKLASFNVGQDVPVLSGSQTTSGDNVFNTVERKTVGTKLKVTPQVNEGDAVLLEIEQEVSSVDSSSNSTLGPTFNTRTIQNAVLVKTGETVVLGGLLDDFSKEQVSKVPLLGDIPLVGQLFRYTSTERAKRNLMVFIRPTIIRDDDVYRSLSKEKYTRYRQEQQQRIDGKSKALVGSEDLPVLDENTFNSHAPAPSSR

SEQ ID NO: 1431 - protein, 601 aa, Escherichia coli
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTDFAWQAAVVGGIGLAMSSTAMALQLMREKGMNRSESGQLGFSVLLFQDLAVIPALALVPLLAGSADEHFDWMKVGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 1432 - protein, 599 aa, Escherichia coli
MTTQVPPSALLPLNPEQLARLQAATTDLTPTQLAWVSGYFWGVLNQQPAALAATPAPAAEMPGITIISASQTGNARRVAEALRDDLLAAKLNVKLVNAGDYKFKQIASEKLLIVVTSTQGEGEPPEEAVALHKFLFSKKAPKLENTAFAVFSLGDSSYEFFCQSGKDFDSKLAELGGERLLDRVDADVEYQAAASEWRARVVDALKSRAPVAAPSQSVATGAVNEIHTSPYSKDAPLVASLSVNQKITGRNSEKDVRHIEIDLGDSGMRYQPGDALGVWYQNDPALVKELVELLWLKGDEPVTVEGKTLPLNEALQWHFELTVNTANIVENYATLTRSETLLPLVGDKAKLQHYAATTPIVDMVRFSPAQLDAEALINLLRPLTPRLYSIASSQAEVENEVHVTVGVVRYDVEGRARAGGASSFLADRVEEEGEVRVFIEHNDNFRLPANPETPVIMIGPGTGIAPFRAFMQQRAADEAPGKNWLFFGNPHFTEDFLYQVEWQRYVKDGVLTRIDLAWSRDQKEKVYVQDKLREQGAELWRWINDGAHIYVCGDANRMAKDVEQALLEVIAEFGGMDTEAADEFLSELRVERRYQRDVY

SEQ ID NO: 1433 - protein, 277 aa, Escherichia coli
MFAVSSRRVLPGFTLSLGTSLLFVCLILLLPLSALVMQLAQMSWAQYWEVITNPQVVAAYKVTLLSAFVASIFNGVFGLLMAWILTRYRFPGRTLLDALMDLPFALPTAVAGLTLASLFSVNGFYGEWLAKFDIKVTYTWLGIAVAMAFTSIPFVVRTVQPVLEELGPEYEEAAETLGATRWQSFCKVVLPELSPALVAGVALSFTRSLGEFGAVIFIAGNIAWKTEVTSLMIFVRLQEFDYPAASAIASVILAASLLLLFSINTLQSRFGRRVVGH

SEQ ID NO: 1434 - protein, 449 aa, Escherichia coli
MSTPSARTGGSLDAWFKISQRGSTVRQEVVAGLTTFLAMVYSVIVVPGMLGKAGFPPAAVFVATCLVAGLGSIVMGLWANLPLAIGCAISLTAFTAFSLVLGQHISVPVALGAVFLMGVLFTVISATGIRSWILRNLPHGVAHGTGIGIGLFLLLIAANGVGLVIKNPLDGLPVALGDFATFPVIMSLVGLAVIIGLEKLKVPGGILLTIIGISIVGLIFDPNVHFSGVFAMPSLSDENGNSLIGSLDIMGALNPVVLPSVLALVMTAVFDATGTIRAVAGQANLLDKDGQIIDGGKALTTDSMSSVFSGLVGAAPAAVYIESAAGTAAGGKTGLTAITVGVLFLLILFLSPLSYLVPGYATAPALMYVGLLMLSNVAKIDFADFVDAMAGLVTAVFIVLTCNIVTGIMIGFATLVIGRLVSGEWRKLNIGTVVIAVALVTFYAGGWAI

SEQ ID NO: 1435 - protein, 644 aa, Escherichia coli
MAKNLILWLVIAVVLMSVFQSFGPSESNGRKVDYSTFLQEVNNDQVREARINGREINVTKKDSNRYTTYIPVQDPKLLDNLLTKNVKVVGEPPEEPSLLASIFISWFPMLLLIGVWIFFMRQMQGGGGKGAMSFGKSKARMLTEDQIKTTFADVAGCDEAKEEVAELVEYLREPSRFQKLGGKIPKGVLMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRVPLAPDIDAAIIARGTPGFSGADLANLVNEAALFAARGNKRVVSMVEFEKAKDKIMMGAERRSMVMTEAQKESTAYHEAGHAIIGRLVPEHDPVHKVTIIPRGRALGVTFFLPEGDAISASRQKLESQISTLYGGRLAEEIIYGPEHVSTGASNDIKVATNLARNMVTQWGFSEKLGPLLYAEEEGEVFLGRSVAKAKHMSDETARIIDQEVKALIERNYNRARQLLTDNMDILHAMKDALMKYETIDAPQIDDLMARRDVRPPAGWEEPGASNNSGDNGSPKAPRPVDEPRTPNPGNTMSEQLGDK

SEQ ID NO: 1436 - protein, 225 aa, Escherichia coli
MQENSPLLQLQNVGYLAGDAKILNNINFSLRAGEFKLITGPSGCGKSTLLKIVASLISPTSGTLLFEGEDVSTLKPEIYRQQVSYCAQTPTLFGDTVYDNLIFPWQIRNRQPDPAIFLDFLERFALPDSILTKNIAELSGGEKQRISLIRNLQFMPKVLLLDEITSALDESNKHNVNEMIHRYVREQNIAVLWVTHDKDEINHADKVITLQPHAGEMQEARYELA

SEQ ID NO: 1437 - protein, 432 aa, Escherichia coli
MAESTVTADSKLTSSDTRRRIWAIVGASSGNLVEWFDFYVYSFCSLYFAHIFFPSGNTTTQLLQTAGVFAAGFLMRPIGGWLFGRIADKHGRKKSMLLSVCMMCFGSLVIACLPGYETIGTWAPALLLLARLFQGLSVGGEYGTSATYMSEVAVEGRKGFYASFQYVTLIGGQLLALLVVVVLQHTMEDAALREWGWRIPFALGAVLAVVALWLRRQLDETSQQETRALKEAGSLKGLWRNRRAFIMVLGFTAAGSLCFYTFTTYMQKYLVNTAGMHANVASGIMTAALFVFMLIQPLIGALSDKIGRRTSMLCFGSLAAIFTVPILSALQNVSSPYAAFGLVMCALLIVSFYTSISGILKAEMFPAQVRALGVGLSYAVANAIFGGSAEYVALSLKSIGMETAFFWYVTLMAVVAFLVSLMLHRKGKGMRL

SEQ ID NO: 1438 - protein, 79 aa, Escherichia coli
MENLNMDLLYMAAAVMMGLAAIGAAIGIGILGGKFLEGAARQPDLIPLLRTQFFIVMGLVDAIPMIAVGLGLYVMFAVA

SEQ ID NO: 1439 - protein, 557 aa, Escherichia coli
MAAQGFLLIATFLLVLMVLARPLGSGLARLINDIPLPGTTGVERVLFRALGVSDREMNWKQYLCAILGLNMLGLAVLFFMLLGQHYLPLNPQQLPGLSWDLALNTAVSFVTNTNWQSYSGETTLSYFSQMAGLTVQNFLSAASGIAVIFALIRAFTRQSMSTLGNAWVDLLRITLWVLVPVALLIALFFIQQGALQNFLPYQAVNTVEGAQQLLPMGPVASQEAIKMLGTNGGGFFNANSSHPFENPTALTNFVQMLAIFLIPTALCFAFGEVMGDRRQGRMLLWAMSVIFVICVGVVMWAEVQGNPHLLALGTDSSINMEGKESRFGVLVSSLFAVVTTAASCGAVIAMHDSFTALGGMVPMWLMQIGEVVFGGVGSGLYGMMLFVLLAVFIAGLMIGRTPEYLGKKIDVREMKLTALAILVTPTLVLMGAALAMMTDAGRSAMLNPGPHGFSEVLYAVSSAANNNGSAFAGLSANSPFWNCLLAFCMFVGRFGVIIPVMAIAGSLVSKKSQAASSGTLPTHGPLFVGLLIGTVLLVGALTFIPALALGPVAEYLS

SEQ ID NO: 1440 - protein, 212 aa, Escherichia coli
MFAEYGVLNYWTYLVGAIFIVLVPGPNTLFVLKNSVSSGMKGGYLAACGVFIGDAVLMFLAWAGVATLIKTTPILFNIVRYLGAFYLLYLGSKILYATLKGKNSEAKSDEPQYGAIFKRALILSLTNPKAILFYVSFFVQFIDVNAPHTGISFFILAATLELVSFCYLSFLIISGAFVTQYIRTKKKLAKVGNSLIGLMFVGFAARLATLQS

SEQ ID NO: 1441 - protein, 487 aa, Escherichia coli
MSLAKDNIWKLLAPLVVMGVMFLIPVPDGMPPQAWHYFAVFVAMIVGMILEPIPATAISFIAVTICVIGSNYLLFDAKELADPAFNAQKQALKWGLAGFSSTTVWLVFGAFIFALGYEVSGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGIQISWLQWFLCFLPVGVILLIIAPWLSYVLYKPEITHSEEVATWAGDELKTMGALTRREWTLIGLVLLSLGLWVFGSEVINATAVGLLAVSLMLALHVVPWKDITRYNSAWNTLVNLATLVVMANGLTRSGFIDWFAGTMSTHLEGFSPNATVIVLVLVFYFAHYLFASLSAHTATMLPVILAVGKGIPGVPMEQLCILLVLSIGIMGCLTPYATGPGVIIYGCGYVKSKDYWRLGAIFGVIYISMLLLVGWPILAMWN

SEQ ID NO: 1442 - protein, 120 aa, Escherichia coli
MESLPGQIDKSLDEASLSLRAGSLRTITHILLPLLRPAILSALIYSFVRAITTVSAIVFLVTPDTRVATAYILNRVEDGEYGVAIAYGSILIVVMLAIIFIFDWLIGESRTSRSKAKNQA

SEQ ID NO: 1443 - protein, 259 aa, Escherichia coli
MNSHNITNESLALALMLVVVAILISHKEKLALEKDILWSVGRAIIQLIIVGYVLKYIFSVDDASLTLLMVLFICFNAAWNAQKRSKYIAKAFISSFIAITVGAGITLAVLILSGSIEFIPMQVIPIAGMIAGNAMVAVGLCYNNLGQRVISEQQQIQEKLSLGATPKQASAILIRDSIRAALIPTVDSAKTVGLVSLPGMMSGLIFAGIDPVKAIKYQIMVTFMLLSTASLSTIIACYLTYRKFYNSRHQLVVTQLKKK

SEQ ID NO: 1444 - protein, 683 aa, Escherichia coli
MSALNSLPLPVVRLLAFFHEELSERRPGRVPQTVQLWVGCLLVILISMTFEIPFVALSLAVLFYGIQSNAFYTKFVAILFVVATVLEIGSLFLIYKWSYGEPLIRLIIAGPILMGCMFLMRTHRLGLVFFAVAIVAIYGQTFPAMLDYPEVVVRLTLWCIVVGLYPTLLMTLIGVLWFPSRAISQMHQALNDRLDDAISHLTDSLAPLPETRIEREALALQKLNVFCLADDANWRTQNAWWQSCVATVTYIYSTLNRYDPTSFADSQAIIEFRQKLASEINKLQHAVAEGQCWQSDWRISESEAMAARECNLENICQTLLQLGQMDPNTPPTPAAKPPSMAADAFTNPDYMRYAVKTLLACLICYTFYSGVDWEGIHTCMLTCVIVANPNVGSSYQKMVLRFGGAFCGAILALLFTLLVMPWLDNIVELLFVLAPIFLLGAWIATSSERSSYIGTQMVVTFALATLENVFGPVYDLVEIRDRALGIIIGTVVSAVIYTFVWPESEARTLPQKLAGTLGMLSKVMRIPRQQEVTALRTYLQIRIGLHAAFNACEEMCQRVALERQLDSEERALLIERSQTVIRQGRDLLHAWDATWNSAQALDNALQPDRAGQFADALEKYAAGLATALSRSPQITLEETPASQAILPTLLKQEQHVCQLFARLPDWTAPALTPATEQAQGATQ

SEQ ID NO: 1445 - protein, 233 aa, Escherichia coli
MNKILLQCDNLCKRYQEGSVQTDVLHNVSFSVGEGEMMAIVGSSGSGKSTLLHLLGGLDTPTSGDVIFNGQPMSKLSSAAKAELRNQKLGFIYQFHHLLPDFTALENVAMPLLIGKKKPAEINSRALEMLKAVGLDHRANHRPSELSGGERQRVAIARALVNNPRLVLADEPTGNLDARNADSIFQLLGELNRLQGTAFLVVTHDLQLAKRMSRQLEMRDGRLTAELSLMGAE

SEQ ID NO: 1446 - protein, 402 aa, Escherichia coli
MSRVSQARNLGKYFLLIDNMLVVLGFFVVFPLISIRFVDQMGWAAVMVGIALGLRQFIQQGLGIFGGAIADRFGAKPMIVTGMLMRAAGFATMGIAHEPWLLWFSCLLSGLGGTLFDPPRSALVVKLIRPQQRGRFFSLLMMQDSAGAVIGALLGSWLLQYDFRLVCATGAVLFVLCAAFNAWLLPAWKLSTVRTPVREGMTRVMRDKRFVTYVLTLAGYYMLAVQVMLMLPIMVNDVAGAPSAVKWMYAIEACLSLTLLYPIARWSEKHFRLEHRLMAGLLIMSLSMMPVGMVSGLQQLFTLICLFYIGSIIAEPARETLSASLADARARGSYMGFSRLGLAIGGAIGYIGGGWLFDLGKSAHQPELPWMMLGIIGIFTFLALGWQFSQKRAARRLLERDA

SEQ ID NO: 1447 - protein, 588 aa, Escherichia coli
MNKSRQKELTRWLKQQSVISQRWLNISRLLGFVSGILIIAQAWFMARILQHMIMENIPREALLLPFTLLVLTFVLRAWVVWLRERVGYHAGQHIRFAIRRQVLDRLQQAGPAWIQGKPAGSWATLVLEQIDDMHDYYARYLPQMALAVSVPLLIVVAIFPSNWAAALILLGTAPLIPLFMALVGMGAADANRRNFLALARLSGHFLDRLRGMETLRIFGRGEAEIESIRSASEDFRQRTMEVLRLAFLSSGILEFFTSLSIALVAVYFGFSYLGELDFGHYDTGVTLAAGFLALILAPEFFQPLRDLGTFYHAKAQAVGAADSLKTFMETPLAHPQRGEAELASTDPVTIEAEELFITSPEGKTLAGPLNFTLPAGQRAVLVGRSGSGKSSLLNALSGFLSYQGSLRINGIELRDLSPESWRKHLSWVGQNPQLPAATLRDNVLLARPDASEQELQAALDNAWVSEFLPLLPQGVDTPVGDQAARLSVGQAQRVAVARALLNPCSLLLLDEPAASLDAHSEQRVMEALNAASLRQTTLMVTHQLEDLADWDVIWVMQDGRIIEQGRYAELSVAGGPFATLLAHRQEEI

SEQ ID NO: 1448 - protein, 566 aa, Escherichia coli
MHPTGPHLGPDVLFRESNMKVTLTFNEQRRAAYRQQGLWGDASLADYWQQTARAMPDKIAVVDNHGASYTYSALDHAASCLANWMLAKGIESGDRIAFQLPGWCEFTVIYLACLKIGAVSVPLLPSWREAELVWVLNKCQAKMFFAPTLFKQTRPVDLILPLQNQLPQLQQIVGVDKLAPATSSLSLSQIIADNTSLTTAITTHGDELAAVLFTSGTEGLPKGVMLTHNNILASERAYCARLNLTWQDVFMMPAPLGHATGFLHGVTAPFLIGARSVLLDIFTPDACLALLEQQRCTCMLGATPFVYDLLNVLEKQPADLSALRFFLCGGTTIPKKVARECQQRGIKLLSVYGSTESSPHAVVNLDDPLSRFMHTDGYAAAGVEIKVVDDARKTLPPGCEGEEASRGPNVFMGYFDEPELTARALDEEGWYYSGDLCRMDEAGYIKITGRKKDIIVRGGENISSREVEDILLQHPKIHDACVVAMSDERLGERSCAYVVLKAPHHSLSLEEVVAFFSRKRVAKYKYPEHIVVIEKLPRTTSGKIQKFLLRKDIMRRLTQDVCEEIE

SEQ ID NO: 1449 - protein, 447 aa, Escherichia coli
MHVLNILWVVFGIGLMLVLNLKFKINSMVALLVAALSVGMLAGMDLMSLLHTMKAGFGNTLGELAIIVVFGAVIGKLMVDSGAAHQIAHTLLARLGLRYVQLSVIIIGLIFGLAMFYEVAFIMLAPLVIVIAAEAKIPFLKLAIPAVAAATTAHSLFPPQPGPVALVNAYGADMGMVYIYGVLVTIPSVICAGLILPKFLGNLERPTPSFLKADQPVDMNNLPSFGVSILVPLIPAIIMISTTIANIWLVKDTPAWEVVNFIGSSPIAMFIAMVVAFVLFGTARGHDMQWVMNAFESAVKSIAMVILIIGAGGVLKQTIIDTGIGDTIGMLMSHGNISPYIMAWLITVLIRLATGQGVVSAMTAAGIISAAILDPATGQLVGVNPALLVLATAAGSNTLTHINDASFWLFKGYFDLSVKDTLKTWGLLELVNSVVGLIIVLIISMVA

SEQ ID NO: 1450 - protein, 190 aa, Escherichia coli
MSGLRPALSTFIFLLLITGGVYPLLTTVLGQWWFPWQANGSLIREGDTVRGSALIGQNFTGNGYFHGRPSATAEMPYNPQASGGSNLAVSNPELDKLIAARVAALRAANPDASASVPVELVTASASGLDNNITPQAAAWQIPRVAKARNLSVEQLTQLIAKYSQQPLVKYIGQPVVNIVELNLALDKLDE

SEQ ID NO: 1451 - protein, 392 aa, Escherichia coli
MSHDPQPLGGKIISKPVMIFGPLIVICMLLIVKRLVFGLGSVSDLNGGFPWGVWIAFDLLIGTGFACGGWALAWAVYVFNRGQYHPLVRPALLASLFGYSLGGLSITIDVGRYWNLPYFYIPGHFNVNSVLFETAVCMTIYIGVMALEFAPALFERLGWKVSLQRLNKVMFFIIALGALLPTMHQSSMGSLMISAGYKVHPLWQSYEMLPLFSLLTAFIMGFSIVIFEGSLVQAGLRGNGPDEKSLFVKLTNTISVLLAIFIVLRFGELIYRDKLSLAFAGDFYSVMFWIEVLLMLFPLVVLRVAKLRNDSRMLFLSALSALLGCATWRLTYSLVAFNPGGGYAYFPTWEELLISIGFVAIEICAYIVLIRLLPILPPLKQNDHNRHEASKA

SEQ ID NO: 1452 - protein, 222 aa, Escherichia coli
MIRFEHVSKAYLGGRQALQGVTFHMQPGEMAFLTGHSGAGKSTLLKLICGIERPSAGKIWFSGHDITRLKNREVPFLRRQIGMIFQDHHLLMDRTVYDNVAIPLIIAGASGDDIRRRVSAALDKVGLLDKAKNFPIQLSGGEQQRVGIARAVVNKPAVLLADEPTGNLDDALSEGILRLFEEFNRVGVTVLMATHDINLISRRSYRMLTLSDGHLHGGVGHE

SEQ ID NO: 1453 - protein, 408 aa, Escherichia coli
MGINEIIMYIMMFFMLIAAVDRILSQFGGSARFLGKFGKSIEGSGGQFEEGFMAMGALGLAMVGMTALAPVLAHVLGPVIIPVYEMLGANPSMFAGTLLACDMGGFFLAKELAGGDVAAWLYSGLILGSMMGPTIVFSIPVALGIIEPSDRRYLALGVLAGIVTIPIGCIAGGLVAMYSGVQINGQPVEFTFALILMNMIPVIIVAILVALGLKFIPEKMINGFQIFAKFLVALITLGLAAAVVKFLLGWELIPGLDPIFMAPGDKPGEVMRAIEVIGSISCVLLGAYPMVLLLTRWFEKPLMSVGKVLNMNNIAAAGMVATLANNIPMFGMMKQMDTRGKVINCAFAVSAAFALGDHLGFAAANMNAMIFPMIVGKLIGGVTAIGVAMMLVPKEDATATKTEAEAQS

SEQ ID NO: 1454 - protein, 561 aa, Escherichia coli
MKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 1455 - protein, 399 aa, Escherichia coli
MYQPVALFIGLRYMRGRAADRFGRFVSWLSTIGITLGVMALVTVLSVMNGFERELQNNILGLMPQAILSSEHGSLNPQQLPETAVKLDGVNRVAPITTGDVVLQSARSVAVGVMLGIDPAQKDPLTPYLVNVKQTDLEPGKYNVILGEQLASQLGVNRGDQIRVMVPSASQFTPMGRIPSQRLFNVIGTFAANSEVDGYEMLVNIEDASRLMRYPAGNITGWRLWLDEPLKVDSLSQQKLPEGSKWQDWRDRKGELFQAVRMEKNMMGLLLSLIVAVAAFNIITSLGLMVMEKQGEVAILQTQGLTPRQIMMVFMVQGASAGIIGAILGAALGALLASQLNNLMPIIGVLLDGAALPVAIEPLQVIVIALVAMAIALLSTLYPSWRAAATQPAEALRYE

SEQ ID NO: 1456 - protein, 366 aa, Escherichia coli
MIIIRYLVRETLKSQLAILFILLLIFFCQKLVRILGAAVDGDIPANLVLSLLGLGVPEMAQLILPLSLFLGLLMTLGKLYTESEITVMHACGLSKAVLVKAAMILAVFTAIVAAVNVMWAGPWSSRHQDEVLAEAKANPGMAALAQGQFQQATNGSSVLFIESVDGSDFKDVFLAQIRPKGNARPSVVVADSGHLTQLRDGSQVVTLNQGTRFEGTALLRDFRITDFQDYQAIIGHQAVALDPNDTDQMDMRTLWNTDTDRARAELNWRITLVFTVFMMALMVVPLSVVNPRQGRVLSMLPAMLLYLLFFLIQTSLKSNGGKGKLDPTLWMWTVNLIYLALAIVLNLWDTVPVRRLRASFSRKGAV

SEQ ID NO: 1457 - protein, 338 aa, Escherichia coli
MAVNLLKKNSLALVASLLLAGHVQATELLNSSYDVSRELFAALNPPFEQQWAKDNGGDKLTIKQSHAGSSKQALAILQGLKADVVTYNQVTDVQILHDKGKLIPADWQSRLPNNSSPFYSTMGFLVRKGNPKNIHDWNDLVRSDVKLIFPNPKTSGNARYTYLAAWGAADKADGGDKGKTEQFMTQFLKNVEVFDTGGRGATTTFAERGLGDVLISFESEVNNIRKQYEAQGFEVVIPKTNILAEFPVAWVDKNVQANGTEKAAKAYLNWLYSPQAQTIITDYYYRVNNPEVMDKLKDKFPQTELFRVEDKFGSWPEVMKTHFTSGGELDKLLAAGRN

SEQ ID NO: 1458 - protein, 571 aa, Escherichia coli
MSSMTTTDNKAFLNELARLVGSSHLLTDPAKTARYRKGFRSGQGDALAVVFPGSLLELWRVLKACVTADKIILMQAANTGLTEGSTPNGNDYDRDVVIISTLRLDKLHVLGKGEQVLAYPGTTLYSLEKALKPLGREPHSVIGSSCIGASVIGGICNNSGGSLVQRGPAYTEMSLFARINEDGKLTLVNHLGIDLGETPEQILSKLDDDRIKDDDVRHDGRHAHDYDYVHRVRDIEADTPARYNADPDRLFESSGCAGKLAVFAVRLDTFEAEKNQQVFYIGTNQPEVLTEIRRHILANFENLPVAGEYMHRDIYDIAEKYGKDTFLMIDKLGTDKMPFFFNLKGRTDAMLEKVKFFRPHFTDRAMQKFGHLFPSHLPPRMKNWRDKYEHHLLLKMAGDGVGEAKSWLVDYFKQAEGDFFVCTPEEGSKAFLHRFAAAGAAIRYQAVHSDEVEDILALDIALRRNDTEWYEHLPPEIDSQLVHKLYYGHFMCYVFHQDYIVKKGVDVHALKEQMLELLQQRGAQYPAEHNVGHLYKAPETLQKFYRENDPTNSMNPGIGKTSKRKNWQEVE

SEQ ID NO: 1459 - protein, 219 aa, Escherichia coli
MQFDWSAIWPAIPLLIEGAKMTLWISVLGLAGGLVIGLLAGFARTFGGWIANHVALVFIEVIRGTPIVVQVMFIYFALPMAFNDLRIDPFTAAVVTIMINSGAYIAEITRGAVLSIHKGFREAGLALGLSRWETIRYVILPLALRRMLPPLGNQWIISIKDTSLFIVIGVAELTRQGQEIIAGNFRALEIWSAVAVFYLIITLVLSFILRRLERRMKIL

SEQ ID NO: 1460 - protein, 457 aa, Escherichia coli
MTTRLTRWLTTLDNFEAKMAQLPAVRRYGRLTRATGLVLEATGLQLPLGATCVIERQNGSETHEVESEVVGFNGQRLFLMPLEEVEGVLPGARVYAKNISAEGLQSGKQLPLGPALLGRVLDGSGKPLDGLPSPDTTETGALITPPFNPLQRTPIEHVLDTGVRPINALLTVGRGQRMGLFAGSGVGKSVLLGMMARYTRADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGISGGGSITAFYTVLTEGDDQQDPIADSARAILDGHIVLSRRLAEAGHYPAIDIEASISRAMTALISEQHYARVRTFKQLLSSFQRNRDLVSVGAYAKGSDPMLDKAIALWPQLEGYLQQGIFERADWEASLQGLERIFPTVS

SEQ ID NO: 1461 - protein, 210 aa, Escherichia coli
MSLSRTQIVNWLTRCGDIFSTESEYLTGLDREIGDADHGLNMNRGFSKVVEKLPAIADKDIGFILKNTGMTLLSSVGGASGPLFGTFFIRAAQATQARQSLTLEELYQMFRDGADGVISRGKAEPGDKTMCDVWVPVVESLRQSSEQNLSVPVALEAASSIAESAAQSTITMQARKGRASYLGERSIGHQDPGATSVMFMMQMLALAAKE

SEQ ID NO: 1462 - protein, 464 aa, Escherichia coli
MPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 1463 - protein, 211 aa, Escherichia coli
MRLTAKQVTWLKVCLHLAGLLPFLWLVWAINHGGLGADPVKDIQHFTGRTALKFLLATLLITPLARYAKQPLLIRTRRLLGLWCFAWATLHLTSYALLELGVNNLALLGKELITRPYLTLGIISWVILLALAFTSTQAMQRKLGKHWQQLHNFVYLVAILAPIHYLWSVKIISPQPLIYAGLAVLLLALRYKKLRSLFNRLRKQVHNKLSV

SEQ ID NO: 1464 - protein, 1247 aa, Escherichia coli
MSKFLDRFRYFKQKGETFADGHGQLLNTNRDWEDGYRQRWQHDKIVRSTHGVNCTGSCSWKIYVKNGLVTWETQQTDYPRTRPDLPNHEPRGCPRGASYSWYLYSANRLKYPMMRKRLMKMWREAKALHSDPVEAWASIIEDADKAKSFKQARGRGGFVRSSWQEVNELIAASNVYTIKNYGPDRVAGFSPIPAMSMVSYASGARYLSLIGGTCLSFYDWYCDLPPASPQTWGEQTDVPESADWYNSSYIIAWGSNVPQTRTPDAHFFTEVRYKGTKTVAVTPDYAEIAKLCDLWLAPKQGTDAAMALAMGHVMLREFHLDNPSQYFTDYVRRYTDMPMLVMLEERDGYYAAGRMLRAADLVDALGQENNPEWKTVAFNTNGEMVAPNGSIGFRWGEKGKWNLEQRDGKTGEETELQLSLLGSQDEIAEVGFPYFGGDGTEHFNKVELENVLLHKLPVKRLQLADGSTALVTTVYDLTLANYGLERGLNDVNCATSYDDVKAYTPAWAEQITGVSRSQIIRIAREFADNADKTHGRSMIIVGAGLNHWYHLDMNYRGLINMLIFCGCVGQSGGGWAHYVGQEKLRPQTGWQPLAFALDWQRPARHMNSTSYFYNHSSQWRYETVTAEELLSPMADKSRYTGHLIDFNVRAERMGWLPSAPQLGTNPLTIAGEAEKAGMNPVDYTVKSLKEGSIRFAAEQPENGKNHPRNLFIWRSNLLGSSGKGHEFMLKYLLGTEHGIQGKDLGQQGGVKPEEVDWQDNGLEGKLDLVVTLDFRLSSTCLYSDIILPTATWYEKDDMNTSDMHPFIHPLSAAVDPAWEAKSDWEIYKAIAKKFSEVCVGHLGKETDIVTLPIQHDSAAELAQPLDVKDWKKGECDLIPGKTAPHIMVVERDYPATYERFTSIGPLMEKIGNGGKGIAWNTQSEMDLLRKLNYTKAEGPAKGQPMLNTAIDAAEMILTLAPETNGQVAVKAWAALSEFTGRDHTHLALNKEDEKIRFRDIQAQPRKIISSPTWSGLEDEHVSYNAGYTNVHELIPWRTLSGRQQLYQDHQWMRDFGESLLVYRPPIDTRSVKEVIGQKSNGNQEKALNFLTPHQKWGIHSTYSDNLLMLTLGRGGPVVWLSEADAKDLGIADNDWIEVFNSNGALTARAVVSQRVPAGMTMMYHAQERIVNLPGSEITQQRGGIHNSVTRITPKPTHMIGGYAHLAYGFNYYGTVGSNRDEFVVVRKMKNIDWLDGEGNDQVQESVK

SEQ ID NO: 1465 - protein, 412 aa, Escherichia coli
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLAMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKRVKQTGWVIVVLVVALNIWLLVGTALGL

SEQ ID NO: 1466 - protein, 549 aa, Escherichia coli
MKNINPTQTAAWQALQKHFDEMKDVTIADLFAKDGDRFSKFSATFDDQMLVDYSKNRITEETLAKLQDLAKECDLAGAIKSMFSGEKINRTENRAVLHVALRNRSNTPILVDGKDVMPEVNAVLEKMKTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRYKAWRG

SEQ ID NO: 1467 - protein, 463 aa, Escherichia coli
MSHSSAPERATGAVITDWRPEDPAFWQQRGQRIASRNLWISVPCLLLAFCVWMLFSAVAVNLPKVGFNFTTDQLFMLTALPSVSGALLRVPYSFMVPIFGGRRWTAFSTGILIIPCVWLGFAVQDTSTPYSVFIIISLLCGFAGANFASSMANISFFFPKQKQGGALGLNGGLGNMGVSVMQLVAPLVVSLSIFAVFGSQGVKQPDGTELYLANASWIWVPFLAIFTIAAWFGMNDLATSKASIKEQLPVLKRGHLWIMSLLYLATFGSFIGFSAGFAMLSKTQFPDVQILQYAFFGPFIGALARSAGGALSDRLGGTRVTLVNFILMAIFSGLLFLTLPTDGQGGSFMAFFAVFLALFLTAGLGSGSTFQMISVIFRKLTMDRVKAEGGSDERAMREAATDTAAALGFISAIGAIGGFFIPKAFGSSLALTGSPVGAMKVFLIFYIACVVITWAVYGRHSKK

SEQ ID NO: 1468 - protein, 511 aa, Escherichia coli
MNLLKSLAAVSSMTMFSRVLGFARDAIVARIFGAGMATDAFFVAFKLPNLLRRIFAEGAFSQAFVPILAEYKSKQGEDATRVFVSYVSGLLTLALAVVTVAGMLAAPWVIMVTAPGFADTADKFALTSQLLKITFPYILLISLASLVGAILNTWNRFSIPAFAPTLLNISMIGFALFAAPYFNPPVLALAWAVTVGGVLQLVYQLPHLKKIGMLVLPRINFHDAGAMRVVKQMGPAILGVSVSQISLIINTIFASFLASGSVSWMYYADRLMEFPSGVLGVALGTILLPSLSKSFASGNHDEYNRLMDWGLRLCFLLALPSAVALGILSGPLTVSLFQYGKFTAFDALMTQRALIAYSVGLIGLIVVKVLAPGFYSRQDIKTPVKIAIVTLILTQLMNLAFIGPLKHAGLSLSIGLAACLNASLLYWQLRKQKIFTPQPGWMAFLLRLVVAVLVMSGVLLGMLHIMPEWSLGTMPWRLLRLMAVVLAGIAAYFAALAVLGFKVKEFARRTV

SEQ ID NO: 1469 - protein, 254 aa, Escherichia coli
MPQQIELRNIALQAAQPLVHGVSLTLQRGRVLALVGGSGSGKSLTCAATLGILPAGVRQTAGEILADGKPVSPCALRGIKIATIMQNPRSAFNPLHTMHTHARETCLALGKPADDATLTAAIEAVGLENAARVLKLYPFEMSGGMLQRMMIAMAVLCESPFIIADEPTTDLDVVAQARILDLLESIMQKQAPGMLLVTHDMGVVARLADDVAVMSDGKIVEQGDVETLFNAPKHTVTRSLVSAHLALYGMELAS

SEQ ID NO: 1470 - protein, 231 aa, Escherichia coli
MSRSAKPQNGRRRFLRDVVRTAGGLAAVGVALGLQQQTARASGVRLRPPGAINENAFASACVRCGQCVQACPYDTLKLATLASGLSAGTPYFVARDIPCEMCEDIPCAKVCPSGALDREIESIDDARMGLAVLVDQENCLNFQGLRCDVCYRECPKIDEAITLELERNTRTGKHARFLPTVHSDACTGCGKCEKVCVLEQPAIKVLPLSLAKGELGHHYRFGWLEGNNGKS

SEQ ID NO: 1471 - protein, 828 aa, Escherichia coli
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 1472 - protein, 229 aa, Escherichia coli
MILTDPEWQAVLLSLKVSSLAVLFSLPFGIFFAWLLVRCTFPGKALLDSVLHLPLVLPPVVVGYLLLVSMGRRGFIGERLYDWFGITFAFSWRGAVLAAAVMSFPLMVRAIRLALEGVDVKLEQAARTLGAGRWRVFFTITLPLTLPGIIVGTVLAFARSLGEFGATITFVSNIPGETRTIPSAMYTLIQTPGGESGAARLCIISIALAMISLLISEWLARISRERAGR

SEQ ID NO: 1473 - protein, 149 aa, Escherichia coli
MKSHDLKKALCQWTAMLALVVSGAVWAANGVDFSQSPEVSGTQEGAIRMPKEQDRMPLNYVNQPPMIPHSVEGYQVTTNTNRCLQCHGVESYRTTGAPRISPTHFMDSDGKVGAEVAPRRYFCLQCHVPQADTAPIVGNTFTPSKGYGK

SEQ ID NO: 1474 - protein, 414 aa, Escherichia coli
MATLTTTQTSPSLLGGVVIIGGTIIGAGMFSLPVVMSGAWFFWSMAALIFTWFCMLHSGLMILEANLNYRIGSSFDTITKDLLGKGWNVVNGISIAFVLYILTYAYISASGSILHHTFAEMSLNVPARAAGFGFALLVAFVVWLSTKAVSRMTAIVLGAKVITFFLTFGSLLGHVQPATLFNVAESNASYAPYLLMTLPFCLASFGYHGNVPSLMKYYGKDPKTIVKCLVYGTLMALALYTIWLLATMGNIPRPEFIGIAEKGGNIDVLVQALSGVLNSRSLDLLLVVFSNFAVASSFLGVTLGLFDYLADLFGFDDSAVGRLKTALLTFAPPVVGGLLFPNGFLYAIGYAGLAATIWAAIVPALLARASRKRFGSPKFRVWGGKPMIALILVFGVGNALVHILSSFNLLPVYQ

SEQ ID NO: 1475 - protein, 257 aa, Escherichia coli
MSMVETAPSKIQVRNLNFYYGKFHALKNINLDIAKNQVTAFIGPSGCGKSTLLRTFNKMFELYPEQRAEGEILLDGDNILTNSQDIALLRAKVGMVFQKPTPFPMSIYDNIAFGVRLFEKLSRADMDERVQWALTKAALWNETKDKLHQSGYSLSGGQQQRLCIARGIAIRPEVLLLDEPCSALDPISTGRIEELITELKQDYTVVIVTHNMQQAARCSDHTAFMYLGELIEFSNTDDLFTKPAKKQTEDYITGRYG

SEQ ID NO: 1476 - protein, 377 aa, Escherichia coli
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADIGATYYFNKNMSTYVDYKINLLDEDDSFYAANGISTDDIVALGLVYQF

SEQ ID NO: 1477 - protein, 195 aa, Escherichia coli
MINRQQGFTLLEVMAALAIFSMLSVLAFMIFSQASELHQRSQKEIQQFNQLQRTITILDNDLLQLVARRNRSTDKIMVLGEEAIFTTQSRDPLAPLSEAQTLLTVHWYLRNHTLYRAVRTSVDGRKDQPAQAMLEHVESFLLESNSGESQELPLSVTLHLQTQQYGGLQRRFALPEQLAREESPAQTQAGNNNHE

SEQ ID NO: 1478 - protein, 623 aa, Escherichia coli
MPHSDELDAGNVLAVENLNIAFMQDQQKIAAVRNLSFSLQRGETLAIVGESGSGKSVTALALMRLLEQAGGLVQCDKMLLQRRSREVIELSEQNAAQMRHVRGADMAMIFQEPMTSLNPVFTVGEQIAESIRLHQNASREEAMVEAKRMLDQVRIPEAQTILSRYPHQLSGGMRQRVMIAMALSCRPAVLIADEPTTALDVTIQAQILQLIKVLQKEMSMGVIFITHDMGVVAEIADRVLVMYQGEAVETGTVEQIFHAPQHPYTRALLAAVPQLGAMKGLDYPRRFPLISLEHPAKQAPPIEQKTVVDGEPVLRVRNLVTRFPLRSGLLNRVTREVHAVEKVSFDLWPGETLSLVGESGSGKSTTGRALLRLVESQGGEIIFNGQRIDTLSPGKLQALRRDIQFIFQDPYASLDPRQTIGDSIIEPLRVHGLLPGKDAAARVAWLLERVGLLPEHAWRYPHEFSGGQRQRICIARALALNPKVIIADEAVSALDVSIRGQIINLLLDLQRDFGIAYLFISHDMAVVERISHRVAVMYLGQIVEIGPRRAVFENPQHPYTRKLLAAVPVAEPSRQRPQRVLLSDDLPSNIHLRGEEVAAVSLQCVGPGHYVAQPQSEYAFMRR

SEQ ID NO: 1479 - protein, 371 aa, Escherichia coli
MASVQLQNVTKAWGEVVVSKDINLDIHEGEFVVFVGPSGCGKSTLLRMIAGLETITSGDLFIGEKRMNDTPPAERGVGMVFQSYALYPHLSVAENMSFGLKLAGAKKEVINQRVNQVAEVLQLAHLLDRKPKALSGGQRQRVAIGRTLVAEPSVFLLDEPLSNLDAALRVQMRIEISRLHKRLGRTMIYVTHDQVEAMTLADKIVVLDAGRVAQVGKPLELYHYPADRFVAGFIGSPKMNFLPVKVTATAIDQVQVELPMPNRQQVWLPVESRDVQVGANMSLGIRPEHLLPSDIADVILEGEVQVVEQLGNETQIHIQIPSIRQNLVYRQNDVVLVEEGATFAIGLPPERCHLFREDGTACRRLHKEPGV

SEQ ID NO: 1480 - protein, 473 aa, Escherichia coli [sequence omitted]

SEQ ID NO: 1481 - protein, 356 aa, Escherichia coli
MTTFHSLTVAKVESETRDAVTITFAVPQPLQEAYRFRPGQHLTLKASFDGEELRRCYSICRSYLPGEISVAVKAIEGGRFSRYAREHIRQGMTLEVMVPQGHFGYQPQAERQGRYLAIAAGSGITPMLAIIATTLQTEPESQFTLIYGNRTSQSMMFRQALADLKDKYPQRLQLLCIFSQETLDSDLLHGRIDGEKLQSLGASLINFRLYDEAFICGPAAMMDDAETALKALGMPDKTIHLERFNTPGTRVKRSVNVQSDGQKVTVRQDGRDREIVLNADDESILDAALRQGADLPYACKGGVCATCKCKVLRGKVAMETNYSLEPDELAAGYVLSCQALPLTSDVVVDFDAKGMA

SEQ ID NO: 1482 - protein, 95 aa, Escherichia coli
MSNVYWPLYEVFVRGKQGLSHRHVGSLHAADERMALENARDAYTRRSEGCSIWVVKASEIVASQPEERGEFFDPAESKVYRHPTFYTIPDGIEHM

SEQ ID NO: 1483 - protein, 716 aa, Escherichia coli
MDTKKIFKHIPWVILGIIGAFCLAVVALRRGEHISALWIVVASVSVYLVAYRYYSLYIAQKVMKLDPTRATPAVINNDGLNYVPTNRYVLFGHHFAAIAGAGPLVGPVLAAQMGYLPGTLWLLAGVVLAGAVQDFMVLFISSRRNGASLGEMIKEEMGPVPGTIALFGCFLIMIIILAVLALIVVKALAESPWGVFTVCSTVPIALFMGIYMRFIRPGRVGEVSVIGIVLLVASIYFGGVIAHDPYWGPALTFKDTTITFALIGYAFVSALLPVWLILAPRDYLATFLKIGVIVGLALGIVVLNPELKMPAMTQYIDGTGPLWKGALFPFLFITIACGAVSGFHALISSGTTPKLLANETDARFIGYGAMLMESFVAIMALVAASIIEPGLYFAMNTPPAGLGITMPNLHEMGGENAPIIMAQLKDVTAHAAATVSSWGFVISPEQILQTAKDIGEPSVLNRAGGAPTLAVGIAHVFHKVLPMADMGFWYHFGILFEALFILTALDAGTRSGRFMLQDLLGNFIPFLKKTDSLVAGIIGTAGCVGLWGYLLYQGVVDPLGGVKSLWPLFGISNQMLAAVALVLGTVVLIKMKRTQYIWVTVVPAVWLLICTTWALGLKLFSTNPQMEGFFYMASQYKEKIANGTDLTAQQIANMNHIVVNNYTNAGLSILFLIVVYSIIFYGFKTWLAVRNSDKRTDKETPYVPIPEGGVKISSHH

SEQ ID NO: 1484 - protein, 110 aa, Escherichia coli
MNPYIYLGGAILAEVIGTTLMKFSEGFTRLWPSVGTIICYCASFWLLAQTLAYIPTGIAYAIWSGVGIVLISLLSWGFFGQRLDLPAIIGMMLICAGVLIINLLSRSTPH

SEQ ID NO: 1485 - protein, 257 aa, Escherichia coli
MSENKLNVIDLHKRYGEHEVLKGVSLQANAGDVISIIGSSGSGKSTFLRCINFLEKPSEGSIVVNGQTINLVRDKDGQLKVADKNQLRLLRTRLTMVFQHFNLWSHMTVLENVMEAPIQVLGLSKQEARERAVKYLAKVGIDERAQGKYPVHLSGGQQQRVSIARALAMEPEVLLFDEPTSALDPELVGEVLRIMQQLAEEGKTMVVVTHEMGFARHVSTHVIFLHQGKIEEEGAPEQLFGNPQSPRLQRFLKGSLK

SEQ ID NO: 1486 - protein, 258 aa, Escherichia coli
MLAKRIIPCLDVRDGQVVKGVQFRNHEIIGDIVPLAKRYAEEGADELVFYDITASSDGRVVDKSWVSRVAEVIDIPFCVAGGIKSLEDAAKILSFGADKISINSPALADPTLITRLADRFGVQCIVVGIDTWYDAETGKYHVNQYTGDESRTRVTQWETLDWVQEVQKRGAGEIVLNMMNQDGVRNGYDLEQLKKVREVCHVPLIASGGAGTMEHFLEAFRDADVDGALAASVFHKQIINIGELKAYLATQGVEIRIC

SEQ ID NO: 1487 - protein, 206 aa, Escherichia coli
MPDAVQAPYPAYRPEPNMQTITIAPPKRSWFSLLSWAVVLAVLVVSWQGAEMAPLTLIKDGGNMATFAADFFPPDFSQWQDYLTEMAVTLQIAVWGTALAVVLSIPFGLMSAENLVPWWVYQPVRRLMDACRAINEMVFAMLFVVAVGLGPFAGVLACWRCLSTPPACSPSCFPKRWKRLSPARWKAFAPPVPTSSKRSSTACCHR

SEQ ID NO: 1488 - protein, 490 aa, Escherichia coli
MSSLQILQGTFRLSDTKTLQLPQLTLNAGDSWAFVGSNGSGKSALARALAGELPLLKGERQSQFSHITRLSFEQLQKLVSDEWQRNNTDMLGPGEDDTGRTTAEIIQDEVKDAPRCMQLAQQFGITALLDRRFKYLSTGETRKTLLCQALMSEPDLLILDEPFDGLDVASRQQLAERLASLHQSGITLVLVLNRFDEIPEFVQFAGVLADCTLAETGAKEELLQQALVAQLAHSEQLEGVQLPEPDEPSARHALPANEPRIVLNNGVVSYNDRPILNNLSWQVNPGEHWQIVGPNGAGKSTLLSLVTGDHPQGYSNDLTLFGRRRGSGETIWDIKKHIGYVSSSLHLDYRVSTTVRNVILSGYFDSIGIYQAVSDRQQKLVQQWLDILGIDKRTADAPFHSLSWGQQRLALIVRALVKHPTLLILDEPLQGLDPLNRQLIRRFVDVLISEGETQLLFVSHHAEDAPACITHRLEFVPDGGLYRYVLTKIY

SEQ ID NO: 1489 - protein, 596 aa, Escherichia coli
MTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPARATEFSPFELTKAKQDLEMEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAAYGAKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMIEATKGINSYYLTSDGSTMSYRTRVRTPSFAHLQQIPAAIRGSLVSDLIVYLGSIDFVMSDVDR

SEQ ID NO: 1490 - protein, 489 aa, Escherichia coli
MNTTTPMGMLQQPRPFFMIFFVELWERFGYYGVQGVLAVFFVKQLGFSQEQAFVTFGAFAALVYGLISIGGYVGDHLLGTKRTIVLGALVLAIGYFMTGMSLLKPDLIFIALGTIAVGNGLFKANPASLLSKCYPPKDPRLDGAFTLFYMSINIGSLIALSLAPVIADRFGYSVTYNLCGAGLIIALLVYIACRGMVKDIGSEPDFRPMSFSKLLYVLLGSVVMIFVCAWLMHNVEVANLVLIVLSIVVTIIFFRQAFKLDKTGRNKMFVAFVLMLEAVVFYILYAQMPTSLNFFAINNVHHEILGFSINPVSFQALNPFWVVLASPILAGIYTHLGNKGKDLSMPMKFTLGMFMCSLGFLTAAAAGMWFADAQGLTSPWFIVLVYLFQSLGELFISALGLAMIAALVPQHLMGFILGMWFLTQAAAFLLGGYVATFTAVPDNITDPLETLPVYTNVFGKIGLVTLGVAVVMLLMVPWLKRMIATPESH

SEQ ID NO: 1491 - protein, 317 aa, Escherichia coli
MNPLLTDSRRQALRSASHWYAVLSGERVSPQQEARWQQWYEQDQDNQWAWQQVENLRNQLGGVPGDVASRALHDTRLTRRHVMKGLLLLLGAGGGWQLWQSETGEGLRADYRTAKGTVSRQQLEDGSLLTLNTQSAADVRFDAHQRTVRLWYGEIAITTAKDALQRPFRVLTRQGQLTALGTEFTVRQQDNFTQLDVQQHAVEVLLASAPAQKRIVNAGESLQFSASEFGAVKPLDDESTSWTKDILSFSDKPLGEVIATLTRYRNGVLRCDPAVAGLRLSGTFPLKNTDAILNVIAQTLPVKIQSITRYWINISPL

SEQ ID NO: 1492 - protein, 271 aa, Escherichia coli
MTESVARLRGEQLTLGYGKYTVAENLTVEIPDGHFTAIIGPNGCGKSTLLRTLSRLMTPAHGHVWLDGEHIQHYASKEVARRIGLLAQNATTPGDITVQELVARGRYPHQPLFTRWRKEDEEAVTKAMQATGITHLADQSVDTLSGGQRQRAWIAMVLAQETAIMLLDEPTTWLDISHQIDLLELLSELNREKGYTLAAVLHDLNQACRYASHLIALREGKIVAQGAPKEIVTAELIERIYGLRCMIIDDPVAGTPLVVPLGRTAPSTANS

SEQ ID NO: 1493 - protein, 233 aa, Escherichia coli
MKKLITANDIREAHARGEQAMSVVLRASIITPEAREVADLLGFTITECDESIPVTASVPASVPADKTESQRIRETIIAQLPEGQFTESLVAQLMEKVMKEKQSLEQGAMQPSFKSVTGKGGIKVIDGSSVKFGRFDGAEPHCVGLTDLVTGDDGSSMAAGFMQWENAFFPWTLNYDEIDMVLEGELHVRHEGQTMIAKAGDVMFIPKGSSIEFGTTSSVKFLYVAWPANWQSL

SEQ ID NO: 1494 - protein, 375 aa, Escherichia coli
MTINFRRNALQLSVAALFSSAFMANAADVPQVKVTVTDKQCEPMTITVNAGKTQFIIQNHSQKALEWEILKGVMVVEERENIAPGFSQKMTANLQPGEYDMTCGLLTNPKGKLIVKGEATADAAQSDALLSLGGAITAYKAYVMAETTQLVTDTKAFTDAIKAGDIEKAKALYAPTRQHYERIEPIAELFSDLDGSIDAREDDYEQKAADPKFTGFHRLEKALFGDNTTKGMDQYAEQLYTDVVDLQKRISELAFPPSKVVGGAAGLIEEVAASKISGEEDRYSHTDLWDFQANVEGSQKIVDLLRPQLQKANPELLAKVDANFKKVDTILAKYRTKDGFETYDKLTDADRNALKGPITALAEDLAQLRGVLGLD

SEQ ID NO: 1495 - protein, 205 aa, Escherichia coli
MNRFVVAEPLWCTGCNTCLAACSDVHKTQGLQQHPRLALAKTSTITAPVVCHHCEEAPCLQVCPVNAISQRDDAIQLNESLCIGCKLCAVVCPFGAISASGSRPVNAHAQYVFQAEGSLKDGEENAPTQHALLRWEPGVQTVAVKCDLCDFLPEGPACVRACPNQALRLITGDSLQRQMKEKQRLAASWFANGGEDPLSLTQEQR

SEQ ID NO: 1496 - protein, 398 aa, Escherichia coli [sequence omitted]

SEQ ID NO: 1497 - protein, 394 aa, Escherichia coli
MKRQRNVNLLLMLVLLVAVGQMAQTIYIPAIADMARDLNVREGAVQSVMGAYLLTYGVSQLFYGPISDRVGRRPVILVGMSIFMLATLVAVTTSSLTVLIAASAMQGMGTGVGGVMARTLPRDLYERTQLRHANSLLNMGILVSPLLAPLIGGLLDTMWNWRACYLFLLVLCAGVTFSMARWMPETRPVDAPRTRLLTSYKTLFGNSGFNCYLLMLIGGLAGIAAFEACSGVLMGAVLGLSSMTVSILFILPIPAAFFGAWFAGRPNKRFSTLMWQSVICCLLAGLLMWIPDWFGVMNVWTLLVPAALFFFGAGMLFPLATSGAMEPFPFLAGTAGALVGGLQNIGSGVLASLSAMLPQTGQGSLGLLMTLMGLLIVLCWLPLATRMSHQGQPV

SEQ ID NO: 1498 - protein, 511 aa, Escherichia coli
MATSVQTGKAKQLTLLGFFAITASMVMAVYEYPTFATSGFSLVFFLLLGGILWFIPVGLCAAEMATVDGWEEGGVFAWVSNTLGPRWGFAAISFGYLQIAIGFIPMLYFVLGALSYILKWPALNEDPITKTIAALIILWALALTQFGGTKYTARIAKVGFFAGILLPAFILIALAAIYLHSGAPVAIEMDSKTFFPDFSKVGTLVVFVAFILSYMGVEASATHVNEMSNPGRDYPLAMLLLMVAAICLSSVGGLSIAMVIPGNEINLSAGVMQTFTVLMSHVAPEIEWTVRVISALLLLGVLAEIASWIVGPSRGMYVTAQKNLLPAAFAKMNKNGVPVTLVISQLVITSIALIILTNTGGGNNMSFLIALALTVVIYLCAYFMLFIGYIVLVLKHPDLKRTFNIPGGKGVKLVVAIVGLLTSIMAFIVSFLPPDNIQGDSTDMYVELLVVSFLVVLALPFILYAVHDRKGKANTGVTLEPINSQNAPKGHFFLHPRARSPHYIVMNDKKH

SEQ ID NO: 1499 - protein, 422 aa, Escherichia coli
MYDFVIIGGGIIGMSTAMQLIDVYPDARIALLEKESAPACHQTGHNSGVIHAGVYYTPGSLKAQFCLAGNRATKAFCDQNGIRYDNCGKMLVATSDLEMERMRALWERTAANGIEREWLNADELREREPNITGLGGIFVPSSGIVSYRDVTAAMAKIFQSRGGEIIYNAEVSGLNEHKNGVVIRTRQGGEYEASTLISCSGLMADRLVKMLGLEPGFIICPFRGEYFRLAPEHNQIVNHLIYPIPDPAMPFLGVHLTRMIDGSVTVGPNAVLAFKREGYRKRDFSFSDTLEILGSSGIRRVLQNHLRSGLGEMKNSLCKSGYLRLVQKYCPRLSLSDLQPWPAGVRAQAVSPDGKLIDDFLFVTTPRTIHTCNAPSPAATSAIPIGAHIVSKVQTLLASQSNPGRTLRAARSVDALHAAFNQ

SEQ ID NO: 1500 - protein, 353 aa, Escherichia coli
MLEMLMQWYRRRFSDPEAIALLVILVAGFGIIFFFSGLLAPLLVAIVLAYLLEWPTVRLQSIGCSRRWATSIVLVVFVGILLLMAFVVLPIAWQQGIYLIRDMPGMLNKLSDFAATLPRRYPALMDAGIIDAMAENMRSRMLTMGDSVVKISLASLVGLLTIAVYLVLVPLMVFFLLKDKEQMLNAVRRVLPRNRGLAGQVWKEMNQQITNYIRGKVLEMIVVGIATWLGFLLFGLNYSLLLAVLVGFSVLIPYIGAFVVTIPVVGVALFQFGAGTEFWSCFAVYLIIQALDGNLLVPVLFSEAVNLHPLVIILSVVIFGGLWGFWGVFFAIPLATLIKAVIHAWPDGQIAQE

SEQ ID NO: 1501 - protein, 239 aa, Escherichia coli
MDFFSVQNILVHIPIGAGGYDLSWIEAVGTIAGLLCIGLASLEKISNYFFGLINVTLFGIIFFQIQLYASLLLQVFFFAANIYGWYAWSRQTSQNEAELKIRWLPLPKALSWLAVCVVSIGLMTVFINPVFAFLTRVAVMIMQALGLQVVMPELQPDAFPFWDSCMMVLSIVAMILMTRKYVENWLLWVIINVISVVIFALQGVYAMSLEYIILTFIALNGSRMWINSARERGSRALSH

SEQ ID NO: 1502 - protein, 260 aa, Escherichia coli
MKKLVLSLSLVLAFSSATAAFAAIPQNIRIGTDPTYAPFESKNSQGELVGFDIDLAKELCKRINTQCTFVENPLDALIPSLKAKKIDAIMSSLSITEKRQQEIAFTDKLYAADSRLVVAKNSDIQPTVESLKGKRVGVLQGTTQETFGNEHWAPKGIEIVSYQGQDNIYSDLTAGRIDAAFQDEVAASEGFLKQPVGKDYKFGGPSVKDEKLFGVGTGMGLRKEDNELREALNKAFAEMRADGTYEKLAKKYFDFDVYGG

SEQ ID NO: 1503 - protein, 396 aa, Escherichia coli [sequence omitted]

SEQ ID NO: 1504 - protein, 1037 aa, Escherichia coli
MANYFIDRPVFAWVLAIIMMLAGGLAIMNLPVAQYPQIAPPTITVSATYPGADAQTVEDSVTQVIEQNMNGLDGLMYMSSTSDAAGNASITLTFETGTSPDIAQVQVQNKLQLAMPSLPEAVQQQGISVDKSSSNILMVAAFISDNGSLNQYDIADYVASNIKDPLSRTAGVGSVQLFGSEYAMRIWLDPQKLNKYNLVPSDVISQIKVQNNQISGGQLGGMPQAADQQLNASIIVQTRLQTPEEFGKILLKVQQDGSQVLLRDVARVELGAEDYSTVARYNGKPAAGIAIKLAAGANALDTSRAVKEELNRLSAYFPASLKTVYPYDTTPFIEISIQEVFKTLVEAIILVFLVMYLFLQNFRATIIPTIAVPVVILGTFAILSAVGFTINTLTMFGMVLAIGLLVDDAIVVVENVERVIAEDKLPPKEATHKSMGQIQRALVGIAVVLSAVFMPMAFMSGATGEIYRQFSITLISSMLLSVFVAMSLTPALCATILKAAPEGGHKPNALFARFNTLFEKSTQHYTDSTRSLLRCTGRYMVVYLLICAGMAVLFLRTPTSFLPEEDQGVFMTTAQLPSGATMVNTTKVLQQVTDYYLTKEKDNVQSVFTVGGFGFSGQGQNNGLAFISLKPWSERVGEENSVTAIIQRAMIALSSINKAVVFPFNLPAVAELGTASGFDMELLDNGNLGHEKLTQARNELLSLAAQSPNQVTGVRPNGLEDTPMFKVNVNAAKAEAMGVALSDINQTISTAFGSSYVNDFLNQGRVKKVYVQAGTPFRMLPDNINQWYVRNASGTMAPLSAYSSTEWTYGSPRLERYNGIPSMEILGEAAAGKSTGDAMKFMADLVAKLPAGVGYSWTGLSYQEALSSNQAPALYAISLVVVFLALAALYESWSIPFSVMLVVPLGVVGALLATDLRGLSNDVYFQVGLLTTIGLSAKNAILIVEFAVEMMQKEGKTPIEAIIEAARMRLRPILMTSLAFILGVLPLVISHGAGSGAQNAVGTGVMGGMFAATVLAIYFVPVFFVVVEHLFARFKKA

SEQ ID NO: 1505 - protein, 493 aa, Escherichia coli
MRIHSPYPASWALAQRIGYLYSEGEIIYLADTPFERLLDIQRQVGQCQTMTSLSQADFEARLEAVFHQNTGESQQIAQDIDQSVDLLSLSEEMPANEDLLNEDSAAPVIRLINAILSEAIKETASDIHIETYEKTMSIRFRIDGVLRTILQPNKKLAALLISRIKVMARLDIAEKRIPQDGRISLRIGRRNIDVRVSTLPSIYGERAVLRLLDKNSLQLSLNNLGMTAADKQDLENLIQLPHGIILVTGPTGSGKSTTLYAILSALNTPGRNILTVEDPVEYELEGIGQTQVNTRVDMSFARGLRAILRQDPDVVMVGEIRDTETAQIAVQASLTGHLVLSTLHTNSASGAVTRLRDMGVESFLLSSSLAGIIAQRLVRRLCPQCRQFTPVSPQQAQMFKYHQLAVTTIGTPVGCPHCHQSGYQGRMAIHEMMVVTPELRAAIHENVDEQALERLVRQQHKALIKNGLQKVISGDTSWDEVMRVASATLESEA

SEQ ID NO: 1506 - protein, 396 aa, Escherichia coli
MKIKTGARILALSALTTMMFSASALAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITK

SEQ ID NO: 1507 - protein, 513 aa, Escherichia coli
MQLNSTEISELIKQRIAQFNVVSEAHNEGTIVSVSDGVIRIHGLADCMQGEMISLPGNRYAIALNLERDSVGAVVMGPYADLAEGMKVKCTGRILEVPVGRGLLGRVVNTLGAPIDGKGPLDHDGFSAVEAIAPGVIERQSVDQPVQTGYKAVDSMIPIGRGQRELIIGDRQTGKTALAIDAIINQRDSGIKCIYVAIGQKASTISNVVRKLEEHGALANTIVVVATASESAALQYLAPYAGCAMGEYFRDRGEDALIIYDDLSKQAVAYRQISLLLRRPPGREAFPGDVFYLHSRLLERAARVNAEYVEAFTKGEVKGKTGSLTALPIIETQAGDVSAFVPTNVISITDGQIFLETNLFNAGIRPAVNPGISVSRVGGAAQTKIMKKLSGGIRTALAQYRELAAFSQFASDLDDATRKQLDHGQKVTELLKQKQYAPMSVAQQSLVLFAAERGYLADVELSKIGSFEAALLAYVDRDHAPLMQEINQTGGYNDEIEGKLKGILDSFKATQSW

SEQ ID NO: 1508 - protein, 315 aa, Escherichia coli
MRLRKYNKSLGWLSLFAGTVLLSGCNSALLDPKGQIGLEQRSLILTAFGLMLIVVIPAILMAVGFAWKYRASNKDAKYSPNWSHSNKVEAVVWTVPILIIIFLAVLTWKTTHALEPSKPLAHDEKPITIEVVSMDWKWFFIYPEQGIATVNEIAFPANTPVYFKVTSNSVMNSFFIPRLGSQIYAMAGMQTRLHLIANEPGTYDGISASYSGPGFSGMKFKAIATPDRAAFDQWVAKAKQSPNTMSDMAAFEKLAAPSEYNQVEYFSNVKPDLFADVINKFMAHGKSMDMTQPEGEHSAHEGMEGMDMSHAESAH

SEQ ID NO: 1509 - protein, 176 aa, Escherichia coli
MAITGIFFGSDTGNTENIAKMIQKQLGKDVADVHDIAKSSKEDLEAYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQISEELHLDEILNA

SEQ ID NO: 1510 - protein, 188 aa, Escherichia coli
MSVLRSLLTAGVLASGLLWSLNGITATPAAQASDDRYEVTQQRNPDAACLDCHKPDTEGMHGKHASVINPNNKLPVTCTNCHGQPSPQHREGVKDVMRFNEPMYKVGEQNSVCMSCHLPEQLQKAFWPHDVHVTKVACASCHSLHPQQDTMQTLSDKGRIKICVDCHSDQRTNPNFNPASVPLLKEQP

SEQ ID NO: 1511 - protein, 287 aa, Escherichia coli
MANRKRDAGREALEKKGWWRSHRWLVLRRLCQFFVLGMFLSGPWFGVWILHGNYSSSLLFDTVPLTDPLMTLQSLASGHLPATVALTGAVIITVLYALAGKRLFCSWVCPLNPITDLANWLRRRFDLNQSATIPRHIRYVLLVVILVGSALTGTLIWEWINPVSLMGRSLVMGFGSGALLILALFLFDLLVVEHGWCGHICPVGALYGVLGSKGVITVAATDRQKCNRCMDCFHVCPEPHVLRAPVLDEQSPVQVTSRDCMTCGRCVDVCSEDVFTITTRWSSGAKS

SEQ ID NO: 1512 - protein, 268 aa, Escherichia coli
MFTDTINKCAANAARIARLSANNPLGFWVSSAMAGAYVGLGIILIFTLGNLLDPSVRPLVMGATFGIALTLVIIAGSELFTGHTMFLTFGVKAGSISHGQMWAILPQTWLGNLVGSVFVAMLYSWGGGSLLPVDTSIVHSVALAKTTAPAMVLFFKGALCNWLVCLAIWMALRTEGAAKFIAIWWCLLAFIASGYEHSIANMTLFALSWFGNHSEAYTLAGIGHNLLWVTLGNTLSGAVFMGLGYWYATPKANRPVADKFNQTETAAG

SEQ ID NO: 1513 - protein, 220 aa, Escherichia coli
MDYTLTRIDPNGENDRYPLQKQEIVTDPLEQEVNKNVFMGKLNDMVNWGRKNSIWPYNFGLSCCYVEMVTSFTAVHDVARFGAEVLRASPRQADLMVVAGTCFTKMAPVIQRLYDQMLEPKWVISMGACANSGGMYDIYSVVQGVDKFIPVDVYIPGCPPRPEAYMQALMLLQESIGKERRPLSWVVGDQGVYRANMQSERERKRGERIAVTNLRTPDEI

SEQ ID NO: 1514 - protein, 127 aa, Escherichia coli
MLQLLLAVFIGGGTGSVARWLLSMRFNPLHQAIPLGTLTANLIGAFIIGIGFAWFSRMTNIDPVWKVLITTGFCGGLTTFSTFSAEVVFLLQEGRFGWALLNVFVNLLGSFAMTALAFWLFSASTAH

SEQ ID NO: 1515 - protein, 153 aa, Escherichia coli
MIKSWWAEKSTSEKQIVAALAVLSLGVFCWLGVIKPIDTYIAEHQSHAQKIKKDIKWMQDQASTHGLLGHPALTQPIKNILLEEAKRENLAITLENGPDNTLTIHPVTAPLENVSRWLTTAQVTYGIVIEDLQFTLAGNEEITLRHLSFREQQ

SEQ ID NO: 1516 - protein, 369 aa, Escherichia coli
MKRNAKTIIAGMIALAISHTAMADDIKVAVVGAMSGPIAQWGDMEFNGARQAIKDINAKGGIKGDKLVGVEYDDACDPKQAVAVANKIVNDGIKYVIGHLCSSSTQPASDIYEDEGILMISPGATNPELTQRGYQHIMRTAGLDSSQGPTAAKYILETVKPQRIAIIHDKQQYGEGLARSVQDGLKAANANVVFFDGITAGEKDFSALIARLKKENIDFVYYGGYYPEMGQMLRQARSVGLKTQFMGPEGVGNASLSNIAGDAAEGMLVTMPKRYDQDPANQGIVDALKADKKDPSGPYVWITYAAVQSLATALERTGSDEPLALVKDLKANGANTVIGPLNWDEKGDLKGFDFGVFQWHADGSSTAAK

SEQ ID NO: 1517 - protein, 578 aa, Escherichia coli
MDATTIISLFILGSILVTSSILLSSFSSRLGIPILVIFLAIGMLAGVDGVGGIPFDNYPFAYMVSNLALAIILLDGGMRTQASSFRVALGPALSLATLGVLITSGLTGMMAAWLFNLDLIEGLLIGAIVGSTDAAAVFSLLGGKGLNERVGSTLEIESGSNDPMAVFLTITLIAMIQHHESNISWMFIVDILQQFGLGIVIGLGGGYLLLQMINRIALPAGLYPLLALSGGILIFSLTTALEGSGILAVYLCGFLLGNRPIRNRYGILQNFDGLAWLAQIAMFLVLGLLVNPSDLLPIAIPALILSAWMIFFARPLSVFAGLLPFRGFNLRERVFISWVGLRGAVPIILAVFPMMAGLENARLFFNVAFFVVLVSLLLQGTSLSWAAKKAKVVVPPVGRPVSRVGLDIHPENPWEQFVYQLSADKWCVGAALRDLHMPKETRIAALFRDNQLLHPTGSTRLREGDVLCVIGRERDLPALGKLFSQSPPVALDQRFFGDFILEASAKYADVALIYGLEDGREYRDKQQTLGEIVQQLLGAAPVVGDQVEFAGMIWTVAEKEDNEVLKIGVRVAEEEAES

SEQ ID NO: 1518 - protein, 193 aa, Escherichia coli
MRYLATLLLSLAVLITAGCGWHLRDTTQVPSTMKVMILDSGDPNGPLSRAVRNQLRLNGVELLDKETTRKDVPSLRLGKVSIAKDTASVFRNGQTAEYQMIMTVNATVLIPGRDIYPISAKVFRSFFDNPQMALAKDNEQDMIVKEMYDRAAEQLIRKLPSIRAADIRSDEEQTSTTTDTPATPARVSTTLGN

SEQ ID NO: 1519 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 1520 - protein, 471 aa, Escherichia coli
MKQSTIALALLPLLFTPVTKARTPEMPVLENRAAQGDITAPGGARRLTGDQTAALRDSLSDKPAKNIILLIGDGMGDSEITAARNYAEGAGGFFKGIDALPLTGQYTHYALNKKTGKPDYVTDSAASATAWSTGVKTYNGALGVDIHEKDHPTILEMAKAAGLATGNVSTAELQDATPAALVAHVTSRKCYGPSATSEKCPGNALEKGGKGSITEQLLNARADVTLGGGAKTFAETATAGEWQGKTLREQAQARGYQLVSDAASLNSVTEANQQKPLLGLFADGNMPVRWLGPKATYHGNIDKPAVTCTPNPQRNDSVPTLAQMTDKAIELLSKNEKGFFLQVEGASIDKQDHAANPCGQIGETVDLDEAVQRALEFAKKEGNTLVIVTADHAHASQIVAPDTKAPGLTQALNTKDGAVMVMSYGNSEEDSQEHTGSQLRIAAYGPHAANVVGLTDQTDLFYTMKAALGLK

SEQ ID NO: 1521 - protein, 226 aa, Escherichia coli
MIQYLNVFFYDIYPYICATVFFLGSWLRYDYGQYTWRASSSQMLDKRGMVIWSNLFHIGILGIFFGHLFGMLTPHWMYAWFLPVAAKQLMAMVLGGICGVLTLIGGAGLLWRRLTNQRVRATSTTPDIIIMSILLIQCLLGLSTIPFSAQYPDGSEMMKLVGWAQSIVTFRGGSSEMLNGVAFVFRLHLVLGMTIFLLFPFTRLVHVWSAPFEYFTRRYQIVRSRR

SEQ ID NO: 1522 - protein, 283 aa, Escherichia coli
MSSLLLFNDKSRALQADIVAVQSQVVYGSVGNSIAVPAIKQNGLNVFAVPTVLLSNTPHYDTFYGGAIPDEWFSGYLRALQERDALRQLRAVTTGYMGTASQIKILAEWLTALRKDHPDLLIMVDPVIGDIDSGIYVKPDLPEAYRQYLLPLAQGITPNIFELEILTGKNCRDLDSAIAAAKSLLSDTLKWVVVTSASGNEENQEMQVVVVTADSVNVISHSRVKTDLKGTGDLFCAQLISGLLKGKALTDAVHRAGLRVLEVMRYTQQHESDELILPPLAEA

SEQ ID NO: 1523 - protein, 452 aa, Escherichia coli
MSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWMFVVALVAFMTAFNLRSLKSVANFNTVIVVLQVVLIAVILGMVVYGVFEGEGAGTLASTRPFWSGDAHVIPMITGATILCFSFTGFDGISNLSEETKDAERVIPRAIFLTALIGGMIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAAIGLIYLACVTKSFRNPVPQYEDVA

SEQ ID NO: 1524 - protein, 238 aa, Escherichia coli
MIEILHEYWKPLLWTDGYRFTGVAITLWLLILSVVIGGVLALFLAIGRVSSNKYIQFPIWLFTYIFRGTPLYVQLLVFYSGMYTLEIVKGTEFLNAFFRSGLNCTVLALTLNTCAYTTEIFAGAIRSVPHGEIEAARAYGFSTFKMYRCIILPSALRIALPAYSNEVILMLHSTALAFTATVPDLLKIARDINAATYQPFTAFGIAAVLYLIISYVLISLFRRAEKRWLQHVKPSSTH

SEQ ID NO: 1525 - protein, 415 aa, Escherichia coli
MKGSYKSRWVIVIVVVIAAIAAFWFWQGRNDSRSAAPGATKQAQQSPAGGRRGMRSGPLAPVQAATAVEQAVPRYLTGLGTITAANTVTVRSRVDGQLIALHFQEGQQVKAGDLLAEIDPSQFKVALAQAQGQLAKDKATLANARRDLARYQQLAKTNLVSRQELDAQQALVSETEGTIKADEASVASAQLQLDWSRITAPVDGRVGLKQVDVGNQISSGDTTGIVVITQTHPIDLVFTLPESDIATVVQAQKAGKPLVVEAWDRTNSKKLSEGTLLSLDNQIDATTGTIKVKARFNNQDDALFPNQFVNARMLVDTEQNAVVIPTAALQMGNEGHFVWVLNSENKVSKHLVTPGIQDSQKVVIRAGISAGDRVVTDGIDRLTEGAKVEVVEAQSATTPEEKATSREYAKKGARS

SEQ ID NO: 1526 - protein, 439 aa, Escherichia coli
MSQAKSNKMGVVQLTILTMVNMMGSGIIMLPTKLAEVGTISIISWLVTAVGSMALAWAFAKCGMFSRKSGGMGGYAEYAFGKSGNFMANYTYGVSLLIANVAIAISAVGYGTELLGASLSPVQIGLATIGVLWICTVANFGGARITGQISSITVWGVIIPVVGLCIIGWFWFSPTLYVDSWNPHHAPFFSAVGSSIAMTLWAFLGLESACANTDVVENPERNVPIAVLGGTLGAAVIYIVSTNVIAGIVPNMELANSTAPFGLAFAQMFTPEVGKVIMALMVMSCCGSLLGWQFTIAQVFKSSSDEGYFPKIFSRVTKVDAPVQGMLTIVIIQSGLALMTISPSLNSQFNVLVNLAVVTNIIPYILSMAALVIIQKVANVPPSKAKVANFVAFVGAMYSFYALYSSGEEAMLYGSIVTFLGWTLYGLVSPRFELKNKHG

SEQ ID NO: 1527 - protein, 512 aa, Escherichia coli
MAITKSTPAPLTGGTLWCVTIALSLATFMQMLDSTISNVAIPTISGFLGASTDEGTWVITSFGVANAIAIPVTGRLAQRIGELRLFLLSVTFFSLSSLMCSLSTNLDVLIFFRVVQGLMAGPLIPLSQSLLLRNYPPEKRTFALALWSMTVIIAPICGPILGGYICDNFSWGWIFLINVPMGIIVLTLCLTLLKGRETETSPVKMNLPGLTLLVLGVGGLQIMLDKGRDLDWFNSSTIIILTVVSVISLISLVIWESTSENPILDLSLFKSRNFTIGIVSITCAYLFYSGAIVLMPQLLQETMGYNAIWAGLAYAPIGIMPLLISPLIGRYGNKIDMRLLVTFSFLMYAVCYYWRSVTFMPTIDFTGIILPQFFQGFAVACFFLPLTTISFSGLPDNKFANASSMSNFFRTLSGSVGTSLTMTLWGRRESLHHSQLTATIDQFNPVFNSSSQIMDKYYGSLSGVLNEINNEITQQSLSISANEIFRMAAIAFILLTVLVWFAKPPFTAKGVG

SEQ ID NO: 1528 - protein, 522 aa, Escherichia coli [sequence omitted]

SEQ ID NO: 1529 - protein, 417 aa, Escherichia coli [sequence omitted]

SEQ ID NO: 1530 - protein, 149 aa, Escherichia coli
MFSPQSRLRHAVADTFAMVVYCSVVNMCIEVFLSGMSFEQSFYSRLVAIPVNILIAWPYGMYRDLFMRAARKVSPSGWIKNLADILAYVTFQSPVYVAILLVVGADWHQIMAAVSSNIVVSMLMGAVYGYFLDYCRRLFKVSRYQQVKA

SEQ ID NO: 1531 - protein, 379 aa, Escherichia coli
MIDYEVLRFIWWLLVGVLLIGFAVTDGFDMGVGMLTRFLGRNDTERRIMINSIAPHWDGNQVWLITAGGALFAAWPMVYAAAFSGFYVAMILVLASLFFRPVGFDYRSKIEETRWRNMWDWGIFIGSFVPPLVIGVAFGNLLQGVPFNVDEYLRLYYTGNFFQLLNPFGLLAGVVSVGMIITQGATYLQMRTVGELHLRTRATAQVAALVTLVCFALAGVWVMYGIDGYVVKSTMDHYAASNPLNKEVVREAGAWLVNFNNTPILWAIPALGVVLPLLTILTARMDKAAWAFVFSSLTLACIILTAGIAMFPFVMPSSTMMNASLTMWDATSSQLTLNVMTWVAVVLVPIILLYTAWCYWKMFGRITKEDIERNTHSLY

SEQ ID NO: 1532 - protein, 446 aa, Escherichia coli
MLFTIQLIIILICLFYGARKGGIALGLLGGIGLVILVFVFHLQPGKPPVDVMLVIIAVVAASATLQASGGLDVMLQIAEKLLRRNPKYVSIVAPFVTCTLTILCGTGHVVYTILPIIYDVAIKNNIRPERPMAASSIGAQMGIIASPVSVAVVSLVAMLGNVTFDGRHLEFLDLLAITIPSTLIGILAIGIFSWFRGKDLDKDEEFQKFISVPENREYVYGDTATLLDKKLPKSNWLAMWIFLGAIAVVALLGADSDLRPSFGGKPLSMVLVIQMFMLLTGALIIILTKTNPASISKNEVFRSGMIAIVAVYGIAWMAETMFGAHMSEIQGVLGEMVKEYPWAYAIVLLLVSKFVNSQAAALAAIVPVALAIGVDPAYIVASAPACYGYYILPTYPSDLAAIQFDRSGTTHIGRFVINHSFILPGLIGVSVSCVFGWIFAAMYGFL

SEQ ID NO: 1533 - protein, 334 aa, Escherichia coli
MSGSVAVTRAIAVPGLLLLLIIATALSLLIGAKSLPASVVLEAFSGTCQSADCTIVLDARLPRTLAGLLAGGALGLAGALMQTLTRNPLADPGLLGVNAGASFAIVLGAALFGYSSAQEQLAMAFAGALVASLIVAFTGSQGGGQLSPVRLTLAGVALAAVLEGLTSGIALLNPDVYDQLRFWQAGSLDIRNLHTLKVVLIPVLIAGATALLLSRALNSLSLGSDTATALGSRVARTQLIGLLAITVLCGSATAIVGPIAFIGLMMPHMARWLVGADHRWSLPVTLLATPALLLFADIIGRVIVPGELRVSVVSAFIGAPVLIFLVRRKTRGGA

SEQ ID NO: 1534 - protein, 377 aa, Escherichia coli
MSSLNIKQGSDAHFPDYPLASPSNNEIDLLNLISVLWRAKKTVMAVVFAFACAGLLISFILPQKWTSAAVVTPPEPVQWQELEKSFTKLRVLDLDIKIDRTEAFNLFIKKFQSVSLLEEYLRSSPYVMDQLKEAKIDELDLHRAIVALSEKMKAVDDNASKKKDEPSLYTSWTLSFTAPTSEEAQTVLSGYIDYISTLVVKESLENVRNKLEIKTQFEKEKLAQDRIKTKNQLDANIQRLNYSLDIANAAGIKKPVYSNGQAVKDDPDFSISLGADGIERKLEIEKAVTDVAELNGELRNRQYLVEQLTKAHVNDVNFTPFKYQLSPSLPVKKDGPGKAIIVILSALIGGMVACGGVLLRYAMASRKQDAMMADHLV

SEQ ID NO: 1535 - protein, 516 aa, Escherichia coli
MKRSISFRPTLLALVLATNFPVAHAAVPKDMLVIGKAADPQTLDPAVTIDNNDWTVTYPSYQRLVQYKTDGDKGSTDVEGDLASSWKASDDQKEWTFTLKDNAKFADGTPVTAEAVKLSFERLLKIGQGPAEAFPKDLKIDAPDEHTVKFTLSQPFAPFLYTLANDGASIINPAVLKEHAADDARGFLAQNTAGSGPFMLKSWQKGQQLVLVPNPHYPGNKPNFKRVSVKIIGESASRRLQLSRGDIDIADALPVDQLNALKQENKVNVAEYPSLRVTYLYLNNSKAPLNQADLRRAISWSTDYQGMVNGILSGNGKQMRGPIPEGMWGYDATAMQYNHDETKAKAEWDKVTSKPTSLTFLYSDNDPNWEPIALATQSSLNKLGIIVKLEKLANATMRDRVGKGDYDIAIGNWSPDFADPYMFMNYWFESDKKGLPGNRSFYENSEVDKLLRNALATTDQTQRTRDYQQAQKIVIDDAAYVYLFQKNYQLAMNKEVKGFVFNPMLEQVFNINTMSK

SEQ ID NO: 1536 - protein, 239 aa, Escherichia coli
MVIKAQSPAGFAEEYIIESIWNNRFPPGTILPAERELSELIGVTRTTLREVLQRLARDGWLTIQHGKPTKVNNFWETSGLNILETLARLDHESVPQLIDNLLSVRTNISTIFIRTAFRQHPDKAQEVLATANEVADHADAFAELDYNIFRGLAFASGNPIYGLILNGMKGLYTRIGRHYFANPEARSLALGFYHKLSALCSEGAHDQVYETVRRYGHESGEIWHRMQKNLPGDLAIQGR

SEQ ID NO: 1537 - protein, 244 aa, Escherichia coli
MAEMKNLKIEVVRYNPEVDTAPHSAFYEVPYDATTSLLDALGYIKDNLAPDLSYRWSCRMAICGSCGMMVNNVPKLACKTFLRDYTDGMKVEALANFPIERDLVVDMTHFIESLEAIKPYIIGNSRTADQGTNIQTPAQMAKYHQFSGCINCGLCYAACPQFGLNPEFIGPAAITLAHRYNEDSRDHGKKERMAQLNSQNGVWSCTFVGYCSEVCPKHVDPAAAIQQGKVESSKDFLIATLKPR

SEQ ID NO: 1538 - protein, 382 aa, Escherichia coli
MSDESDDKTEAPTPHRLEKAREEGQIPRSRELTSLLILLVGVSVIWFGGVSLARRLSGMLSAGLHFDHSIINDPNLILGQIILLIREAMLALLPLISGVVLVALISPVMLGGLVFSGKSLQPKFSKLNPLPGIKRMFSAQTGAELLKAILKTILVGSVTGFFLWHHWPQMMRLMAESPITAMGNAMDLVGLCALLVVLGVIPMVGFDVFFQIFSHLKKLRMSRQDIRDEFKQSEGDPHVKGRIRQMQRAAARRRMMADVPKADVIVNNPTHYSVALQYDENKMSAPKVVAKGAGLVALRIREIGAENNVPTLEAPPLARALYRHAEIGQQIPGQLYAAVAEVLAWVWQLKRWRLAGGQRPVQPTHLPVPEALDFINEKPTHE

SEQ ID NO: 1539 - protein, 470 aa, Escherichia coli
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPDLSDWVASLAVIVLLLTLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFALIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVVVLLTLEDDTRQALLVTPLWFIALGLGWLFIGKKRAAELRK

SEQ ID NO: 1540 - protein, 445 aa, Escherichia coli
MGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPTTTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTTLAIASSLILVASTFVWAPIPGLICAVIVIATGLPAYAFWAKRSRQLNALS

SEQ ID NO: 1541 - protein, 457 aa, Escherichia coli
MSPCKLLPFCVALALTGCSLAPDYQRPAMPVPQQFSLSQNGLVNAADNYQNAGWRTFFVDNQVKTLISEALVNNRDLRMATLKVQEARAQYRLTDADRYPQLNGEGSGSWSGNLKGNTATTREFSTGLNASFDLDFFGRLKNMSEAERQNYLATEEAQRAVHILLVSNVAQSYFNQQLAYAQLQIAEETLRNYQQSYAFVEKQLLTGSSNVLALEQARGVIESTRSDIAKRQGELAQANNALQLLLGSYGKLPQAQTVNSDSLQSVKLPAGLSSQILLQRPDIMEAEHALMAANANIGAARAAFFPSISLTSGISTASSDLSSLFNASSGMWNFIPKIEIPIFNAGRNQANLDIAEIRQQQSVVNYEQKIQNAFKEVADALALRQSLNDQISAQQRYLASLQITLQRARALYQHGAVSYLEVLDAERSLFATRQTLLDLNYARQVNEISLYTALGGG

SEQ ID NO: 1542 - protein, 321 aa, Escherichia coli
MRIGQYQLRNRLIAAPMAGITDRPFRTLCYEMGAGLTVSEMMSSNPQVWESDKSRLRMVHIDEPGIRTVQIAGSDPKEMADAARINVESGAQIIDINMGCPAKKVNRKLAGSALLQYPDVVKSILTEVVNAVDVPVTLKIRTGWAPEHRNCEEIAQLAEDCGIQALTIHGRTRACLFNGEAEYDSIRAVKQKVSIPVIANGDITDPLKARAVLDYTGADALMIGRAAQGRPWIFREIQHYLDTGELLPPLPLAEVKRLLCAHVRELHDFYGPAKGYRIARKHVSWYLQEHAPNDQFRRTFNAIEDASEQLEALEAYFENFA

SEQ ID NO: 1543 - protein, 285 aa, Escherichia coli
MKADNPFDLLLPAAMAKVAEEAGVYKATKHPLKTFYLAITAGVFISIAFVFYITATTGTGTMPFGMAKLVGGICFSLGLILCVVCGADLFTSTVLIVVAKASGRITWGQLAKNWLNVYFGNLVGALLFVLLMWLSGEYMTANGQWGLNVLQTADHKVHHTFIEAVCLGILANLMVCLAVWMSYSGRSLMDKAFIMVLPVAMFVASGFEHSIANMFMIPMGIVIRDFASPEFWTAVGSAPENFSHLTVMNFITDNLIPVTIGNIIGGGLLVGLTYWVIYLRENDHH

SEQ ID NO: 1544 - protein, 455 aa, Escherichia coli
MFGIIISVIVLITMGYLILKNYKPQVVLAAAGIFLMMCGVWLGFGGVLDPTKSSGYLIVDIYNEILRMLSNRIAGLGLSIMAVGGYARYMERIGASRAMVSLLSRPLKLIRSPYIILSATYVIGQIMAQFITSASGLGMLLMVTLFPTLVSLGVSRLSAVAVIATTMSIEWGILETNSIFAAQVAGMKIATYFFHYQLPVASCVIISVAISHFFVQRAFDKKDKNINHEQAEQKALDNVPPLYYAILPVMPLILMLGSLFLAHVGLMQSELHLVVVMLLSLTVTMFVEFFRKHNLRETMDDVQAFFDGMGTQFANVVTLVVAGEIFAKGLTTIGTVDAVIRGAEHSGLGGIGVMIIMALVIAICAIVMGSGNAPFMSFASLIPNIAAGLHVPAVVMIMPMHFATTLARAVSPITAVVVVTSGIAGVSPFAVVKRTAIPMAVGFVVNMIATITLFY

SEQ ID NO: 1545 - protein, 256 aa, Escherichia coli
MKIITCYKCVPDEQDIAVNNADGSLDFSKADAKISQYDLNAIEAACQLKQQAAEAQVTALSVGGKALTNAKGRKDVLSRGPDELIVVIDDQFEQALPQQTASALAAAAQKAGFDLILCGDGSSDLYAQQVGLLVGEILNIPAVNGVSKIISLTADTLTVERELEDETETLSIPLPAVVAVSTDINSPQIPSMKAILGAAKKPVQVWSAADIGFNAEAAWSEQQVAAPKQRERQRIVIEGDGEEQIAAFAENLRKVI

SEQ ID NO: 1546 - protein, 308 aa, Escherichia coli
MSDTLLTLRDVHINFPARKNWLGKTTEHVHAINGIDLQIRRGETLGIVGESGCGKSTLAQLLMGMLQPSHGQYIRSGSQRIMQMVFQDPLSSLNPRLPVWRIITEPLWIAKRSSEQQRRALAEELAVQVGIRPEYLDRLPHAFSGGQRQRIAIARALSSQPDVIVLDEPTSALDISVQAQILNLLVTLQENHGLTYVLISHNVSVIRHMSDRVAVMYLGQIVELGDAQQVLTAPAHPYTRLLLDSLPAIDKPLEEEWALRKTDLPGNRTLPQGCFFYERCPLATHGCEVRQSLAIREDGRELRCWRAL

SEQ ID NO: 1547 - protein, 692 aa, Escherichia coli
MSNLAAMLRLPANLKSTQWQILAGPILILLILSMMVLPLPAFILDLLFTFNIALSIMVLLVAMFTQRTLEFAAFPTILLFTTLLRLALNVASTRIILMEGHTGAAAAGKVVEAFGHFLVGGNFAIGIVVFVILVIINFMVITKGAGRIAEVGARFVLDGMPGKQMAIDADLNAGLIGEDEAKKRRSEVTQEADFYGSMDGASKFVRGDAIAGILIMVINIVGGLLVGVLQHGMSMGHAAESYTLLTIGDGLVAQIPALVISTAAGVIVTRVSTDQDVGEQMVNQLFSNPSVMLLSAAVLGLLGLVPGMPNLVFLLFTAGLLGLAWWIRGREQKAPAEPKPVKMAENNTVVEATWNDVQLEDSLGMEVGYRLIPMVDFQQDGELLGRIRSIRKKFAQEMGFLPPVVHIRDNMDLQPARYRILMKGVEIGSGDAYPGRWLAINPGTAAGTLPGEATVDPAFGLNAIWIESALKEQAQIQGYTVVEASTVVATHLNHLISQHAAELFGRQEAQQLLDRVAQEMPKLTEDLVPGVVTLTTLHKVLQNLLDEKVPIRDMRTILETLAEHAPIQSDPHELTAVVRVALGRAITQQWFPGKDEVHVIGLDTPLERLLLQALQGGGGLEPGLADRLLAQTQEALSRQEMLGAPPVLLVNHALRPLLSRFLRRSLPQLVVLSNLELSDNRHIRMTATIGGK

SEQ ID NO: 1548 - protein, 253 aa, Escherichia coli
MVSSFTSAPRSGFYYFAQGWKLVSQPGIRRFVILPLLVNILLMGGAFWWLFTQLDVWIPTLMSYVPDWLQWLSYLLWPLAVISVLLVFGYFFSTIANWIAAPFNGLLAEQLEARLTGATPPDTGIFGIMKDVPRIMKREWQKFAWYLPRAIVLLILYFIPGIGQTVAPVLWFLFSAWMLAIQYCDYPFDNHKVPFKEMRTALRTRKITNMQFGALTSLFTMIPLLNLFIMPVAVCGATAMWVDCYRDKHAMWR

SEQ ID NO: 1549 - protein, 298 aa, Escherichia coli
MMLSEETSAVRPQKQTRFNGAKLVWMLKGSPLTVTSAVIIVLMLLMMIFSPWLATHDPNAIDLTARLLPPSAAHWFGTDEVGRDLFSRVLVGSQQSILAGLVVVAIAGMIGSLLGCLSGVLGGRADAIIMRIMDIMLSIPSLVLTMALAAALGPSLFNAMLAIAIVRIPFYVRLARGQALVVRQYTYVQAAKTFGASRWHLINWHILRNSLPPLIVQASLDIGSAILMAATLGFIGLGAQQPSAEWGAMVANGRNYVLDQWWYCAFPGAAILLTAVGFNLFGDGIRDLLDPKAGGKQS

SEQ ID NO: 1550 - protein, 328 aa, Escherichia coli
MTQPVLDIQQLHLSFPGFNGDVHALNNVSLQINRGEIVGLVGESGSGKSVTAMLIMRLLPTGSYCVHRGQISLLGEDVLNAREKQLRQWRGARVAMIFQEPMTALNPTRRIGLQMMDVIRHHQPISRREARAKAIDLLEEMQIPDAVEVMSRYPFELSGGMRQRVMIALAFSCEPQLIIADEPTTALDVTVQLQVLRLLKHKARASGTAVLFISHDMAVVSQLCDSVYVMYAGSVIESGVTADVIHHPRHPYTIGLLQCAPEHGVPRQLLPAIPGTVPNLTHLPDGCAFRDRCYAAGAQCENVPALTACGDNNQRCACWYPQQEVISV

SEQ ID NO: 1551 - protein, 328 aa, Escherichia coli
MSSVSTSGSGAPKSSFSFGRIWDQYGMLVVFAVLFIACAIFVPNFATFINMKGLGLAISMSGMVACGMLFCLASGDFDLSVASVIACAGVTTAVVINLTESLWIGVAAGLLLGVLCGLVNGFVIAKLKINALITTLATMQIVRGLAYIISDGKAVGIEDESFFALGYANWFGLPAPIWLTVACLIIFGLLLNKTTFGRNTLAIGGNEEAARLAGVPVVRTKIIIFVLSGLVSAIAGIILASRMTSGQPMTSIGYELIVISACVLGGVSLKGGIGKISYVVAGILILGTVENAMNLLNISPFAQYVVRGLILLAAVIFDRYKQKAKRTV

SEQ ID NO: 1552 - protein, 428 aa, Escherichia coli
MKIATIKTGLASLAMLPGLVMAAPAVADKADNAFMMICTALVLFMTIPGIALFYGGLIRGKNVLSMLTQVTVTFALVCILWVVYGYSLAFGEGNNFFGNINWLMLKNIELTAVMGSIYQYIHVAFQGSFACITVGLIVGALAERIRFSAVLIFVVVWLTLSYIPIAHMVWGGGLLASHGALDFAGGTVVHINAAIAGLVGAYLIGKRVGFGKEAFKPHNLPMVFTGTAILYIGWFGFNAGSAGTANEIAALAFVNTVVATAAAILGWIFGEWALRGKPSLLGACSGAIAGLVGVTPACGYIGVGGALIIGVVAGLAGLWGVTMLKRLLRVDDPCDVFGVHGVCGIVGCIMTGIFAASSLGGVGFAEGVTMGHQLLVQLESIAITIVWSGVVAFIGYKLADLTVGLRVPEEQEREGLDVNSHGENAYNA

SEQ ID NO: 1553 - protein, 390 aa, Escherichia coli
MSANAETQTPQQPVKKSGKRKRLLLLLTLLFIIIAVAIGIYWFLVLRHFEETDDAYVAGNQIQIMSQVSGSVTKVWADNTDFVKEGDVLVTLDPTDARQAFEKAKTALASSVRQTHQLMINSKQLQANIEVQKIALAKAQSDYNRRVPLGNANLIGREELQHARDAVTSAQAQLDVAIQQYNANQAMILGTKLEDQPAVQQAATEVRNAWLALERTRIISPMTGYVSRRAVQPGAQISPTTPLMAVVPATNMWVDANFKETQIANMRIGQPVTITTDIYGDDVKYTGKVVGLDMGTGSAFSLLPAQNATGNWIKVVQRLPVRIELDQKQLEQYPLRIGLSTLVSVNTTNRDGQVLANKVRSTPVAVSTAREISLAPVNKLIDDIVKANAG

SEQ ID NO: 1554 - protein, 165 aa, Escherichia coli
MLKPEMIEKLNEQMNLELYSSLLYQQMSAWCSYHTFEGAAAFLRRHAQEEMTHMQRLFDYLTDTGNLPRINTVESPFAEYSSLDELFQETYKHEQLITQKINELAHAAMTNQDYPTFNFLQWYVSEQHEEEKLFKSIIDKLSLAGKSGEGLYFIDKELSTLDTQN

SEQ ID NO: 1555 - protein, 461 aa, Escherichia coli
MLTFIELLIGVVVIVGVARYIIKGYSATGVLFVGGLLLLIISAIMGHKVLPSSQASTGYSATDIVEYVKILLMSRGGDLGMMIMMLCGFAAYMTHIGANDMVVKLASKPLQYINSPYLLMIAAYFVACLMSLAVSSATGLGVLLMATLFPVMVNVGISRGAAAAICASPAAIILAPTSGDVVLAAQASEMSLIDFAFKTTLPISIAAIIGMAIAHFFWQRYLDKKEHISHEMLDVSEITTTAPAFYAILPFTPIIGVLIFDGKWGPQLHIITILVICMLIASILEFLRSFNTQKVFSGLEVAYRGMADAFANVVMLLVAAGVFAQGLSTIGFIQSLISIATSFGSASIILMLVLVILTMLAAVTTGSGNAPFYAFVEMIPKLAHSSGINPAYLTIPMLQASNLGRTLSPVSGVVVAVAGMAKISPFEVVKRTSVPVLVGLVIVIVATELMVPGTAAAVTGK

SEQ ID NO: 1556 - protein, 358 aa, Escherichia coli
MKLTLKNLSMAIMMSTIVMGSSAMAADSNEKIVIAHRGASGYLPEHTLPAKAMAYAQGADYLEQDLVMTKDDNLVVLHDHYLDRVTDVADRFPDRARKDGRYYAIDFTLDEIKSLKFTEGFDIENGKKVQTYPGRFPMGKSDFRVHTFEEEIEFVQGLNHSTGKNIGIYPEIKAPWFHHQEGKDIAAKTLEVLKKYGYTGKDDKVYLQCFDADELKRIKNELEPKMGMELNLVQLIAYTDWNETQQKQPDGSWVNYNYDWMFKPGAMKQVAEYADGIGPDYHMLIEETSQPGNIKLTGMVQDAQQNKLVVHPYTVRSDKLPEYTPDVNQLYDALYNKAGVNGLFTDFPDKAVKFLNKE

SEQ ID NO: 1557 - protein, 111 aa, Escherichia coli
MPKIVILPHQDLCPDGAVLEANSGETILDAALRNGIEIEHACEKSCACTTCHCIVREGFDSLPESSEQEDDMLDKAWGLEPESRLSCQARVTDEDLVVEIPRYTINHAREH

SEQ ID NO: 1558 - protein, 159 aa, Escherichia coli
MNIRRKNRLWIACAVLAGLALTIGLVLYALRSNIDLFYTPGEILYGKRETQQMPEVGQRLRVGGMVMPGSVQRDPNSLKVTFTIYDAEGSVDVSYEGILPDLFREGQGVVVQGELEKGNHILAKEVLAKHDENYTPPEVEKAMEANHRRPASVYKDPAS

SEQ ID NO: 1559 - protein, 514 aa, Escherichia coli
MWDVIDLSRWQFALTALYHFLFVPLTLGLIFLLAIMETIYVVTGKTIYRDMTRFWGKLFGINFALGVATGLTMEFQFGTNWSFYSNYVGDIFGAPLAMEALMAFFLESTFVGLFFFGWQRLNKYQHLLVTWLVAFGSNLSALWILNANGWMQYPTGAHFDIDTLRMEMTSFSELVFNPVSQVKFVHTVMAGYVTGAMFIMAISAWYLLRGRERNVALRSFAIGSVFGTLAIIGTLQLGDSSAYEVAQVQPVKLAAMEGEWQTEPAPAPFHVVAWPEQDQERNAFALKIPALLGILATHSLDKPVPGLKNLMAETYPRLQRGRMAWLLMQEISQGNREPHVLQAFRGLEGDLGYGMLLSRYAPDMNHVTAAQYQAAMRGAIPQVAPVFWSFRIMVGCGSLLLLVMLIALVQTLRGKIDQHRWVLKMALWSLPLPWIAIEAGWFMTEFGRQPWAIQDILPTYSAHSALTTGQLAFSLIMIVGLYTLFLIAEVYLMQKYARLGPSAMQSEQPTQQQG

SEQ ID NO: 1560 - protein, 245 aa, Escherichia coli [sequence omitted]

SEQ ID NO: 1561 - protein, 69 aa, Escherichia coli
MTPAFASWNEFFAMGGYAFFVWLAVVMTVIPLVVLVVHSVMQHRAILRGVAQQRAREARLRAAQQQEAA

SEQ ID NO: 1562 - protein, 207 aa, Escherichia coli
MGMLEARELLCERDERTLFSGLSFTLNAGEWVQITGSNGAGKTTLLRLLTGLSRPDAGEVLWQGQPLHQVRDSYHQNLLWIGHQPGIKTRLTALENLHFYHRDGDTAQCLEALAQAGLAGFEDIPVNQLSAGQQRRVALARLWLTRATLWILDEPFTAIDVNGVDRLTQRMAQHTEQGGIVILTTHQPLNVAESKIRRISLTQTRAA

SEQ ID NO: 1563 - protein, 37 aa, Escherichia coli
MWYFAWILGTLLACSFGVITALALEHVESGKAGQEDI

SEQ ID NO: 1564 - protein, 444 aa, Escherichia coli
MSSAKKIGLFACTGVVAGNMMGSGIALLPANLASIGGIAIWGWIISIIGAMSLAYVYARLATKNPQQGGPIAYAGEISPAFGFQTGVLYYHANWIGNLAIGITAVSYLSTFFPVLNDPVPAGIACIAIVWVFTFVNMLGGTWVSRLTTIGLVLVLIPVVMTAIVGWHWFDAATYAANWNTADTTDGHAIIKSILLCLWAFVGVESAAVSTGMVKNPKRTVPLATMLGTGLAGIVYIAATQVLSGMYPSSVMAASGAPFAISASTILGNWAAPLVSAFTAFACLTSLGSWMMLVGQAGVRAANDGNFPKVYGEVDSNGIPKKGLLLAAVKMTALMILITLMNSAGGKASDLFGELTGIAVLLTMLPYFYSCVDLIRFEGVNIRNFVSLICSVLGCVFCFIALMGASSFELAGTFIVSLIILMFYARKMHERQSHSMDNHTASNAH

SEQ ID NO: 1565 - protein, 385 aa, Escherichia coli
MTKHARFFLLPSFILISAALIAGCNDKGEEKAHVGEPQVTVHIVKTAPLEVKTELPGRTNAYRIAEVRPQVSGIVLNRNFTEGSDVQAGQSLYQIDPATYQANYDSAKGELAKSEAAAAIAHLTVKRYVPLVGTKYISQQEYDQAIADARQADAAVIAAKATVESARINLAYTKVTAPISGRIGKSTVTEGALVTNGQTTELATVQQLDPIYVDVTQSSNDFMRLKQSVEQGNLHKENATSNVELVMENGQTYPLKGTLQFSDVTVDESTGSITLRAVFPNPQHTLLPGMFVRARIDEGVQPDAILIPQQGVSRTPRGDATVLIVNDKSQVEARPVVASQAIGDKWLISEGLKSGDQVIVSGLQKARPGEQVKATTDTPADTASK

SEQ ID NO: 1566 - protein, 177 aa, Escherichia coli
MRLLPLVAAATAAFLVVACSSPTPPRGVTVVNNFDAKRYLGTWYEIARFDHRFERGLEKVTATYSLRDDGGLNVINKGYNPDRGMWQQSEGKAYFTGAPTRAALKVSFFGPFYGGYNVIALDREYRHALVCGPDRDYLWILSRTPTISDEVKQEMLAVATREGFDVSKFIWVQQPGS

SEQ ID NO: 1567 - protein, 188 aa, Escherichia coli
MSFTNTPERYGVISAAFHWLSAIIVYGMFALGLWMVTLSYYDGWYHKAPELHKSIGILLMMGLVIRVLWRVISPPPGPLPSYSPMTRLAARAGHLALYLLLFAIGISGYLISTADGKPISVFGWFDVPATLADAGAQADFAGALHFWLAWSVVVLSVMHGFMALKHHFIDKDDTLKRMLGKSSSDYGV

SEQ ID NO: 1568 - protein, 49 aa, Escherichia coli
MLELLKSLVFAVIMVPVVMAIILGLIYGLGEVFNIFSGVGKKDQPGQNH

SEQ ID NO: 1569 - protein, 260 aa, Escherichia coli
MKKSILALSLLVGLSTAASSYAALPETVRIGTDTTYAPFSSKDAKGDFVGFDIDLGNEMCKRMQVKCTWVASDFDALIPSLKAKKIDAIISSLSITDKRQQEIAFSDKLYAADSRLIAAKGSPIQPTLDSLKGKHVGVLQGSTQEAYANETWRSKGVDVVAYANQDLVYSDLAAGRLDAALQDEVAASEGFLKQPAGKDFAFAGSSVKDKKYFGDGTGVGLRKDDAELTAAFNKALGELRQDGTYDKMAKKYFDFNVYGD

SEQ ID NO: 1570 - protein, 419 aa, Escherichia coli
MSQDNNFSQGPVPQSARKGVLALTFVMLGLTFFSASMWTGGTLGTGLSYHDFFLAVLIGNLLLGIYTSFLGYIGAKTGLTTHLLARFSFGVKGSWLPSLLLGGTQVGWFGVGVAMFAIPVGKATGLDINLLIAVSGLLMTVTVFFGISALTVLSVIAVPAIACLGGYSVWLAVNGMGGLDALKAVVPAQPLDFNVALALVVGSFISAGTLTADFVRFGRNAKLAVLVAMVAFFLGNSLMFIFGAAGAAALGMADISDVMIAQGLLLPAIVVLGLNIWTTNDNALYASGLGFANITGMSSKTLSVINGIIGTVCALWLYNNFVGWLTFLSAAIPPVGGVIIADYLMNRRRYEHFATTRMMSVNWVAILAVALGIAAGHWLPGIVPVNAVLGGALSYLILNPILNRKTTAAMTHVEANSVE

SEQ ID NO: 1571 - protein, 565 aa, Escherichia coli
MAQRIFTLILLLCSTSVFAGLFDAPGRSQFVPADQAFAFDFQQNQHDLNLTWQIKDGYYLYRKQIRITPEHAKIADVQLPQGVWHEDEFYGKSEIYRDRLTLPVTINQASAGATLTVTYQGCADAGFCYPPETKTVPLSEVVANNAAPQPVSVPQQEQPTAQLPFSALWALLIGIGIAFTPCVLPMYPLISGIVLGGKQRLSTARALLLTFIYVQGMALTYTALGLVVAAAGLQFQAALQHPYVLIGLAIVFTLLAMSMFGLFTLQLPSSLQTRLTLMSNRQQGGSPGGVFVMGAIAGLICSPCTTAPLSAILLYIAQSGNMWLGGGTLYLYALGMGLPLMLITVFGNRLLPKSGPWMEQVKTAFGFVILALPVFLLERVIGDVWGLRLWSALGVAFFGWAFITSLQAKRGWMRIVQIILLAAALVSVRPLQDWAFGATHTAQTQTHLNFTQIKTVDELNQALVEAKGKPVMLDLYADWCVACKEFEKYTFSDPQVQKALADTVLLQANVTANDAQDVALLKHLNVLGLPTILFFDGQGQEHPQARVTGFMDAETFSAHLRDRQP

SEQ ID NO: 1572 - protein, 397 aa, Escherichia coli
MSESVHTNTSLWSKGMKAVIVAQFLSAFGDNALLFATLALLKAQFYPEWSQPILQMVFVGAYILFAPFVGQVADSFAKGRVMMFANGLKLLGAASICFGINPFLGYTLVGVGAAAYSPAKYGILGELTTGSKLVKANGLMEASTIAAILLGSVAGGVLADWHVLVALAACALAYGGAVVANIYIPKLAAARPGQSWNLINMTRSFLNACTSLWRNGETRFSLVGTSLFWGAGVTLRFLLVLWVPVALGITDNATPTYLNAMVAIGIVVGAGAAAKLVTLETVSRCMPAGILIGVVVLIFSLQHELLPAYALLMLIGVMGGFFVVPLNALLQERGKKSVGAGNAIAVQNLGENSAMLLMLGIYSLAVMIGIPVVPIGIGFGALFALAITALWIWQRRH

SEQ ID NO: 1573 - protein, 184 aa, Escherichia coli
MMSQPAKVLLLYAHPESQDSVANRVLLKPATQLSNVTVHDLYAHYPDFFIDIPREQALLREHEVIVFQHPLYTYSCPALLKEWLDRVLSRGFASGPGGNQLAGKYWRSVITTGEPESAYRYDALNRYPMSDVLRPFELAAGMCRMHWLSPIIIYWARRQSAQELASHARAYGDWLANPLSPGGR

SEQ ID NO: 1574 - protein, 125 aa, Escherichia coli
MNKQSGMTLLEVLLAMSIFTAVALTLMSSMQGQRNAIERMRNETLALWIADNQLQSQDSFGEENTSSSGKELINGEEWNWRSDIHSSKDGTLLERTITVTLPSGQTTSLTRYQSIDNKSGQAQDD

SEQ ID NO: 1575 - protein, 446 aa, Escherichia coli [sequence omitted]

SEQ ID NO: 1576 - protein, 620 aa, Escherichia coli
MDSHTLIQALIYLGSAALIVPIAVRLGLGSVLGYLIAGCIIGPWGLRLVTDAESILHFAEIGVVLMLFIIGLELDPQRLWKLRAAVFGCGALQMVICGGLLGLFCMLLGLRWQVAELIGMTLALSSTAIAMQAMNERNLMVTQMGRSAFAVLLFQDIAAIPLVAMIPLLATSSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLLENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYIRLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 1577 - protein, 500 aa, Escherichia coli
MSTANQKPTESVSLNAFKQPKAFYLIFSIELWERFGYYGLQGIMAVYLVKQLGMSEADSITLFSSFSALVYGLVAIGGWLGDKVLGTKRVIMLGAIVLAIGYALVAWSGHDAGIVYMGMAAIAVGNGLFKANPSSLLSTCYEKNDPRLDGAFTMYYMSVNIGSFFSMIATPWLAAKYGWSVAFALSVVGLLITIVNFAFCQRWVKQYGSKPDFEPINYRNLLLTIIGVVALIAIATWLLHNQEVARMALGVVAFGIVVIFGKEAFAMKGAARRKMIVAFILMLEAIIFFVLYSQMPTSLNFFAIRNVEHSILGLAVEPEQYQALNPFWIIIGSPILAAIYNKMGDTLPMPTKFAIGMVMCSGAFLILPLGAKFASDAGIVSVSWLVASYGLQSIGELMISGLGLAMVAQLVPQRLMGFIMGSWFLTTAGANLIGGYVAGMMAVPDNVTDPLMSLEVYGRVFLQIGVATAVIAVLMLLTAPKLHRMTQDDAADKAAKAAVA

SEQ ID NO: 1578 - protein, 129 aa, Escherichia coli [sequence omitted]

SEQ ID NO: 1579 - protein, 106 aa, Escherichia coli
MNRIYACPVADVPEGEALRIDTSPVIALFNVGGEFYAINDRCSHGNASMSEGYLEDDATVECPLHAASFCLKTGKALCLPATDPLTTYPVHVEGGDIFIDLPEAQP

SEQ ID NO: 1580 - protein, 176 aa, Escherichia coli
MFLIITRDTMFFTAMKNILSKGNVVHIQNEEEIDVMLHQNAFVIIDTLMNNVFHSNFLTQIERLKPVHVIIFSPFNIKRCLGKVPVTFVPRTITIIDFVALINGSYCSVPEAAVSLSRKQHQVLSCIANQMTTEDILEKLKISLKTFYCHKHNIMMILNLKRINELVRHQHIDYLV

SEQ ID NO: 1581 - protein, 294 aa, Escherichia coli
MAMETQDIIKRSATNSITPPSQVRDYKAEVAKLIDVSTCIGCKACQVACSEWNDIRDEVGHCVGVYDNPADLSAKSWTVMRFSETEQNGKLEWLIRKDGCMHCEDPGCLKACPSAGAIIQYANGIVDFQSENCIGCGYCIAGCPFNIPRLNKEDNRVYKCTLCVDRVSVGQEPACVKTCPTGAIHFGTKKEMLELAEQRVAKLKARGYEHAGVYNPEGVGGTHVMYVLHHADQPELYHGLPKDPKIDTSVSLWKGALKPLAAAGFIATFAGLIFHYIGIGPNKEVDDDEEDHHE

SEQ ID NO: 1582 - protein, 470 aa, Escherichia coli
MSLSRRQFIQASGIALCAGAVPLKASAAGQQQPLPVPPLLESRRGQPLFMTVQRAHWSFTPGTRASVWGINGRYLGPTIRVWKGDDVKLIYSNRLTENVSMTVAGLQVPGPLMGGPARMMSPNADWAPVLPIRQNAATLWYHANTPNRTAQQVYNGLAGMWLVEDEVSKSLPIPNHYGVDDFPVIIQDKRLDNFGTPEYNEPGSGGFVGDTLLVNGVQSPYVEVSRGWVRLRLLNASNSRRYQLQMNDGRPLHVISGDQGFLPAPVSVKQLSLAPGERREILVDMSNGDEVSITCGEAASIVDRIRGFFEPSSILVSTLVLTLRPTGLLPLVTDSLPMRLLPTEIMAGSPIRSRDISLGDDPGINGQLWDVNRIDVTAQQGTWERWTVRADEPQAFHIEGVMFQIRNVNGAMPFPEDRGWKDTVWVDGQVELLVYFGQPSWAHFPFYFNSQTLEMADRGSIGQLLVNPVP

SEQ ID NO: 1583 - protein, 296 aa, Escherichia coli
MSGLPLISRRRLLTAMALSPLLWQMNTAHAAAIDPNRIVALEWLPVELLLALGIVPYGVADTINYRLWVSEPPLPDSVIDVGLRTEPNLELLTEMKPSFMVWSAGYGPSPEMLARIAPGRGFNFSDGKQPLAMARKSLTEMADLLNLQSAAETHLAQYEDFIRSMKPRFVKRGARPLLLTTLIDPRHMLVFGPNSLFQEILDEYGIPNAWQGETNFWGSTAVSIDRLAAYKDVDVLCFDHDNSKDMDALMATPLWQAMPFVRAGRFQRVPAVWFYGATLSAMHFVRVLDNAIGGKA

SEQ ID NO: 1584 - protein, 204 aa, Escherichia coli
MATDTLTHATAHAHEHGHHDAGGTKIFGFWIYLMSDCILFSILFATYAVLVNGTAGGPTGKDIFELPFVLVETFLLLFSSITYGMAAIAMYKNNKSQVISWLALTWLFGAGFIGMEIYEFHHLIVNGMGPDRSGFLSAFFALVGTHGLHVTSGLIWMAVLMVQIARRGLTSTNRTRIMCLSLFWHFLDVVWICVFTVVYLMGAM

SEQ ID NO: 1585 - protein, 248 aa, Escherichia coli
MKSVLKVSLAALTLAFAVSSHAADKKLVVATDTAFVPFEFKQGDKYVGFDVDLWAAIAKELKLDYELKPMDFSGIIPALQTKNVDLALAGITITDERKKAIDFSDGYYKSGLLVMVKANNNDVKSVKDLDGKVVAVKSGTGSVDYAKANIKTKDLRQFPNIDNAYMELGTNRADAVLHDTPNILYFIKTAGNGQFKAVGDSLEAQQYGIAFPKGSDELRDKVNGALKTLRENGTYNEIYKKWFGTEPK

SEQ ID NO: 1586 - protein, 747 aa, Escherichia coli
MARSKTAQPKHSLRKIAVVVATAVSGMSVYAQAAVEPKEDTITVTAAPAPQESAWGPAATIAARQSATGTKTDTPIQKVPQSISVVTAEEMALHQPKSVKEALSYTPGVSVGTRGASNTYDHLIIRGFAAEGQSQNNYLNGLKLQGNFYNDAVIDPYMLERAEIMRGPVSVLYGKSSPGGLLNMVSKRPTTEPLKEVQFKAGTDSLFQTGFDFSDSLDDDGVYSYRLTGLARSANAQQKGSEEQRYAIAPAFTWRPDDKTNFTFLSYFQNEPETGYYGWLPKEGTVEPLPNGKRLPTDFNEGAKNNTYSRNEKMVGYSFDHEFNDTFTVRQNLRFAENKTSQNSVYGYGVCSDPANAYSKQCAALAPADKGHYLARKYVVDDEKLQNFSVDTQLQSKFATGDIDHTLLTGVDFMRMRNDINAWFGYDDSVPLLNLYNPVNTDFDFNAKDPANSGPYRILNKQKQTGVYVQDQAQWDKVLVTLGGRYDWADQESLNRVAGTTDKRDDKQFTWRGGVNYLFDNGVTPYFSYSESFEPSSQVGKDGNIFAPSKGKQYEVGVKYVPEDRPIVVTGAVYNLTKTNNLMADPEGSFFSVEGGEIRARGVEIEAKAALSASVNVVGSYTYTDAEYTTDTTYKGNTPAQVPKHMASLWADYTFFDGPLSGLTLGTGGRYTGSSYGDPANSFKVGSYTVVDALVRYDLARVGMAGSNVALHVNNLFDREYVASCFNTYGCFWGAERQVVATATFRF

SEQ ID NO: 1587 - protein, 434 aa, Escherichia coli
MTTPLKKIVIVGGGAGGLEMATQLGHKLGRKKKAKITLVDRNHSHLWKPLLHEVATGSLDEGVDALSYLAHARNHGFQFQLGSVIDIDREAKTITIAELRDEKGELLVPERKIAYDTLVMALGSTSNDFNTPGVKENCIFLDNPHQARRFHQEMLNLFLKYSANLGANGKVNIAIVGGGATGVELSAELHNAVKQLHSYGYKGLTNEALNVTLVEAGERILPALPPRISAAAHNELTKLGVRVLTQTMVTSADEGGLHTKDGEYIEADLMVWAAGIKAPDFLKDIGGLETNRINQLVVEPTLQTTRDPDIYAIGDCASCPRPEGGFVPPRAQAAHQMATCAMNNILAQMNGKPLKNYQYKDHGSLVSLSNFSTVGSLMGNLTRGSMMIEGRIARFVYISLYRMHQIALHGYFKTGLMMLVGSINRVIRPRLKLH

SEQ ID NO: 1588 - protein, 430 aa, Escherichia coli
MDIPVNAAKPGRRRYLTLVMIFITVVICYVDRANLAVASAHIQEEFGITKAEMGYVFSAFAWLYTLCQIPGGWFLDRVGSRVTYFIAIFGWSVATLFQGFATGLMSLIGLRAITGIFEAPAFPTNNRMVTSWFPEHERASAVGFYTSGQFVGLAFLTPLLIWIQEMLSWHWVFIVTGGIGIIWSLIWFKVYQPPRLTKGISKAELDYIRDGGGLVDGDAPVKKEARQPLTAKDWKLVFHRKLIGVYLGQFAVASTLWFFLTWFPNYLTQEKGITALKAGFMTTVPFLAAFVGVLLSGWVADLLVRKGFSLGFARKTPIICGLLISTCIMGANYTNDPMMIMCLMALAFFGNGFASITWSLVSSLAPMRLIGLTGGVFNFAGGLGGITVPLVVGYLAQGYGFAPALVYISAVALIGALSYILLVGDVKRVG

SEQ ID NO: 1589 - protein, 95 aa, Escherichia coli
MTSPVNVDVKLGVNKFNVDEEHPHIVVKADADKQALELLVKACPAGLYKKQDDGSVRFDYAGCLECGTCRILGLGSALEQWEYPRGTFGVEFRYG

SEQ ID NO: 1590 - protein, 246 aa, Escherichia coli
MLDQVCQLARNAGDAIMQVYDGTKPMDVVSKADNSPVTAADIAAHTVIMDGLRTLTPDVPVLSEEDPPGWEVRQHWQRYWLVDPLDGTKEFIKRNGEFTVNIALIDHGKPILGVVYAPVMNVMYSAAEGKAWKEECGVRKQIQVRDARPPLVVISRSHADAELKEYLQQLGEHQTTSIGSSLKFCLVAEGQAQLYPRFGPTNIWDTAAGHAVAAAAGAHVHDWQGKPLDYTPRESFLNPGFRVSIY

SEQ ID NO: 1591 - protein, 291 aa, Escherichia coli
MAEVTQLKRYDARPINWGKWFLIGIGMLVSAFILLVPMIYIFVQAFSKGLMPVLQNLADPDMLHAIWLTVMIALIAVPVNLVFGILLAWLVTRFNFPGRQLLLTLLDIPFAVSPVVAGLVYLLFYGSNGPLGGWLDEHNLQIMFSWPGMVLVTIFVTCPFVVRELVPVMLSQGSQEDEAAILLGASGWQMFRRVTLPNIRWALLYGVVLTNARAIGEFGAVSVVSGSIRGETLSLPLQIELLEQDYNTVGSFTAAALLTLMAIITLFLKSMLQWRLENQEKRAQQEEHHEH

SEQ ID NO: 1592 - protein, 471 aa, Escherichia coli
MTDLPDSTRWQLWIVAFGFFMQSLDTTIVNTALPSMAQSLGESPLHMHMVIVSYVLTVAVMLPASGWLADKVGVRNIFFTAIVLFTLGSLFCALSGTLNELLLARALQGVGGAMMVPVGRLTVMKIVPREQYMAAMTFVTLPGQVGPLLGPALGGLLVEYASWHWIFLINIPVGIIGAIATLLLMPNYTMQTRRFDLSGFLLLAVGMAVLTLALDGSKGTGLSPLTIAGLVAVGVVALVLYLLHARNNNRALFSLKLFRTRTFSLGLAGSFAGRIGSGMLPFMTPVFLQIGLGFSPFHAGLMMIPMVLGSMGMKRIVVQVVNRFGYRRVLVATTLGLSLVTLLFMTTALLGWYYVLPFVLFLQGMVNSTRFSSMNTLTLKDLPDNLASSGNSLLSMIMQLSMSIGVTIAGLLLGLFGSQHVSVDSGTTQTVFMYTWLSMALIIALPAFIFARVPNDTHQNVAISRRKRSAQ

SEQ ID NO: 1593 - protein, 412 aa, Escherichia coli
MKQWIAALLLMLIPGVQAAKPQKVTLMVDDVPVAQVLQALAEQEKLNLVVSPDVSGTVSLHLTDVPWKQALQTVVKSAGLITRQEGNILSVHSIAWQNNNIARQEAEQARAQANLPLENRSITLQYADAGELAKAGEKLLSAKGSMTVDKRTNRLLLRDNKTALSALEQWVAQMDLPVGQVELSAHIVTINEKSLRELGVKWTLADAQHAGGVGQVTTLGSDLSVATATTHVGFNIGRINGRLLDLELSALEQKQQLDIIASPRLLASHLQPASIKQGSEIPYQVSSGESGATSVEFKEAVLGMEVTPTVLQKGRIRLKLHISQNVPGQVLQQADGEVLAIDKQEIETQVEVKSGETLALGGIFTRKNKSGQDSVPLLGDIPWFGQLFRHDGKEDERRELVVFITPRLVSSE

SEQ ID NO: 1594 - protein, 306 aa, Escherichia coli
MKMNKSLIVLCLSAGLLASAPGISLADVNYVPQNTSDAPAIPSAALQQLTWTPVDQSKTQTTQLATGGQQLNVPGISGPVAAYSVPANIGELTLTLTSEVNKQTSVFAPNVLILDQNMTPSAFFPSSYFTYQEPGVMSADRLEGVMRLTPALGQQKLYVLVFTTEKDLQQTTQLLDPAKAYAKGVGNSIPDIPDPVARHTTDGLLKLKVKTNSSSSVLVGPLFGSSAPAPVTVGNTAAPAVAAPAPAPVKKSEPMLNDTESYFNTAIKNAVAKGDVDKALKLLDEAERLGSTSARSTFISSVKGKG

SEQ ID NO: 1595 - protein, 299 aa, Escherichia coli
MSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIMLGAFTFGERLHGKQLAGIALAIFGVLVLIEDSLNGQHVAMLGFMLTLAAAFSWACGNIFNKKIMSHSTRPAVMSLVIWSALIPIIPFFVASLILDGSATMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 1596 - protein, 452 aa, Escherichia coli
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQERNGG

SEQ ID NO: 1597 - protein, 414 aa, Escherichia coli
MRLSLPRLKMPRLPGFSILVWISTALKGWVMGSREKDTDSLIMYDRTLLWLTFGLAAIGFIMVTSASMPIGQRLTNDPFFFAKRDGVYLILAFILAIITLRLPMEFWQRYSATMLLGSIILLMIVLVVGSSVKGASRWIDLGLLRIQPAELTKLSLFCYIANYLVRKGDEVRNNLRGFLKPMGVILVLAVLLLAQPDLGTVVVLFVTTLAMLFLAGAKLWQFIAIIGMGISAVVLLILAEPYRIRRVTAFWNPWEDPFGSGYQLTQSLMAFGRGELWGQGLGNSVQKLEYLPEAHTDFIFAIIGEELGYVGVVLALLMVFFVAFRAMSIGRKALEIDHRFSGFLACSIGIWFSFQALVNVGAAAGMLPTKGLTLPLISYGGSSLLIMSTAIMMLLRIDYETRLEKAQAFVRGSR

SEQ ID NO: 1598 - protein, 385 aa, Escherichia coli
MNRRRKLLIPLLFCGAMLTACDDKSAENAAAMTPEVGVVTLSPGSVNVLSELPGRTVPYEVAEIRPQVGGIIIKRNFIEGDKVNQGDSLYQIDPAPLQAELNSAKGSLAKALSTASNARITFNRQASLLKTNYVSRQDYDTARTQLNEAEANVTVAKAAVEQATINLQYANVTSPITGVSGKSSVTVGALVTANQADSLVTVQRLDPIYVDLTQSVQDFLRMKEEVASGQIKQVQGSTPVQLNLENGKRYSQTGTLKFSDPTVDETTGSVTLRAIFPNPNGDLLPGMYVTALVDEGSRQNVLLVPQEGVTHNAQGKATALILDKDDVVQLREIEASKAIGDQWVVTSGLQAGDRVIVSGLQRIRPGIKARAISSSQENASTESKQ

SEQ ID NO: 1599 - protein, 559 aa, Escherichia coli
MNKIFSSHVMPFRALIDACWKEKYTAARFTRDLIAGITVGIIAIPLAMALAIGSGVAPQYGLYTAAVAGIVIALTGGSRFSVSGPTAAFVVILYPVSQQFGLAGLLVATLLSGIFLILMGLARFGRLIEYIPVSVTLGFTSGIGITIGTMQIKDFLGLQMAHVPEHYLQKVGALFMALPTINVGDAAIGIVTLGILVFWPRLGIRLPGHLPALLAGCAVMGIVNLLGGHVATIGSQFHYVLADGSQGNGIPQLLPQLVLPWDLPNSEFTLTWDSIRTLLPAAFSMAMLGAIESLLCAVVLDGMTGTKHKANSELVGQGLGNIIAPFFGGITATAAIARSAANVRAGATSPISAVIHSILVILALLVLAPLLSWLPLSAMAALLLMVAWNMSEAHKVVDLLRHAPKDDIIVMLLCMSLTVLFDMVIAISVGIVLASLLFMRRIARMTRLAPVVVDVPDDVLVLRVIGPLFFAAAEGLFTDLESRLEGKRIVILKWDAVPVLDAGGLDAFQRFVKRLPEGCELRVCNVEFQPLRTMARAGIQPIPGRLAFFPNRRAAMADL

SEQ ID NO: 1600 - protein, 877 aa, Escherichia coli
MKAVSRVHITPHMHWDREWYFTTEESRILLVNNMEEILCRLEQDNEYKYYVLDGQTAILEDYFAVKPENKDRVKKQVEAGKLIIGPWYTQTDTTIVSAESIVRNLMYGMRDCLAFGEPMKIGYLPDSFGMSGQLPHIYNGFGITRTMFWRGCSERHGTDKTEFLWQSSDGSEVTAQVLPLGYAIGKYLPADENGLRKRLDSYFDVLEKASVTKEILLPNGHDQMPLQQNIFEVMDKLREIYPQRKFVMSRFEEVFEKIEAQRDNLATLKGEFIDGKYMRVHRTIGSTRMDIKIAHARIENKIVNLLEPLATLAWTLGFEYHHGLLEKMWKEILKNHAHDSIGCCCSDKVHREIVARFELAEDMADNLIRFYMRKIADNMPQSDADKLVLFNLMPWPREEVINTTVRLRASQFNLRDDRGQPVPYFIRHAREIDPGLIDRQIVHYGNYDPFMEFDIQINQIVPSMGYRTLYIEANQPGNVIAAKSDAEGILENAFWQIALNEDGSLQLVDKDSGVRYDRVLQIEESSDDGDEYDYSPAKEEWVITAANAKPQCDIIHEAWQSRAVIRYDMAVPLNLSERSARQSTGRVGVVLVVTLSHNSRRIDVDINLDNQADDHRLRVLVPTPFNTDSVLADTQFGSLTRPVNDSAMNNWQQEGWKEAPVPVWNMLNYVALQEGRNGMAVFSEGLREFEVIGEEKKTFAITLLRGVGLLGKEDLLLRPGRPSGIKMPVPDSQLRGLLSCRLSLLSYTGTPTAAGVAQQARAWLTPVQCYNKIPWDVMKLNKAGFNVPESYSLLKMPPVGCLISALKKAEDRQEVILRLFNPAESATCDATVAFSREVISCSETMMDEHITTEENQGSNLSGPFLPGQSRTFSYRLA

SEQ ID NO: 1601 - protein, 271 aa, Escherichia coli
MAFKFKTFAAVGALIGSLALVGCGQDEKDPNHIKVGVIVGAEQQVAEVAQKVAKDKYGLDVELVTFNDYVLPNEALSKGDIDANAFQHKPYLDQQLKDRGYKLVAVGNTFVYPIAGYSKKIKSLDELQDGSQVAVPNDPTNLGRSLLLLQKVGLIKLKDGVGLLPTVLDVVENPKNLKIVELEAPQLPRSLDDAQIALAVINTTYASQIGLTPAKDGIFVEDKESPYVNLIVTREDNKDAENVKKFVQAYQSDEVYEAANKVFNGGAVKGW

SEQ ID NO: 1602 - protein, 506 aa, Escherichia coli [sequence omitted]

SEQ ID NO: 1603 - protein, 207 aa, Escherichia coli
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 1604 - protein, 191 aa, Escherichia coli
MSKARRWVIIVLSLAVLVMIGINMAEKDDTAQVVVNNNDPTYKSEHTDTLVYNPEGALSYRLIAQHVEYYSDQAVSWFTQPVLTTFDKDKIPTWSVKADKAKLTNDRMLYLYGHVEVNALVPDSQLRRITTDNAQINLVTQDVTSEDLVTLYGTTFNSSGLKMRGNLRSKNAELIEKVRTSYEIQNKQTQP

SEQ ID NO: 1605 - protein, 303 aa, Escherichia coli
MRLFNWRRQAVLNAMPLVKPDQVRTPWHEFWRRFRRQHMAMTAALFVILLIVVAIFARWIAPYDAENYFDYDNLNNGPSLQHWFGVDSLGRDIFSRVLVGAQISLAAGVFAVFIGAAIGTLLGLLAGYYEGWWDRLIMRICDVLFAFPGILLAIAVVAVLGSGIANVIIAVAIFSIPAFARLVRGNTLVLKQQTFIESARSIGASDMTVLLRHILPGTVSSIVVFFTMRIGTSIISAASLSFLGLGAQPPTPEWGAMLNEARADMVIAPHVAVFPALAIFLTVLAFNLLGDGLRDALDPKIKG

SEQ ID NO: 1606 - protein, 251 aa, Escherichia coli
MKLRLSALALGTTLLVGCASSGTDQQGRSDPLEGFNRTMYNFNFNVLDPYIVRPVAVAWRDYVPQPARNGLSNFTGNLEEPAVMVNYFLQGDPYQGMVHFTRFFLNTILGMGGFIDVAGMANPKLQRTEPHRFGSTLGHYGVGYGPYVQLPFYGSFTLRDDGGDMADGFYPVLSWLTWPMSVGKWTLEGIETRAQLLDSDGLLRQSSDPYIMVREAYFQRHDFIANGGELKPQENPNAQAIQDDLKDIDSE

SEQ ID NO: 1607 - protein, 128 aa, Escherichia coli
MGLMWGLFSVIIASVAQLSLGFAASHLPPMTHLWDFIAALLAFGLDARILLLGLLGYLLSVFCWYKTLHKLALSKAYALLSMSYVLVWIASMVLPGWEGTFSLKALLGVACIMSGLMLIFLPTTKQRY

SEQ ID NO: 1608 - protein, 326 aa, Escherichia coli
MLTLARQQQRQNIRWLLCLSVLMLLALLLSLCAGEQWISPGDWFTPRGELFVWQIRLPRTLAVLLVGAALAISGAVMQALFENPLAEPGLLGVSNGAGVGLIAAVLLGQGQLPNWALGLCAIAGALIITLILLRFARRHLSTSRLLLAGVALGIICSALMTWAIYFSTSVDLRQLMYWMMGGFGGVDWRQSWLMLALIPVLLWICCQSRPMNMLALGEISARQLGLPLWFWRNVLVAATGWMVGVSVALAGAIGFIGLVIPHILRLCGLTDHRVLLPGCALAGASALLLADIVARLALAAAELPIGVVTATLGAPVFIWLLLKAGR

SEQ ID NO: 1609 - protein, 445 aa, Escherichia coli
MSHQHTTQTSGQGMLERVFKLREHGTTARTEVIAGFTTFLTMVYIVFVNPQILGVAGMDTSAVFVTTCLIAAFGSIMMGLFANLPVALAPAMGLNAFFAFVVVQAMGLPWQVGMGAIFWGAIGLLLLTIFRVRYWMIANIPVSLRVGITSGIGLFIGMMGLKNAGVIVANPETLVSIGNLTSHSVLLGILGFFIIAILASRNIHAAVLVSIVVTTLLGWMLGDVHYNGIVSAPPSVMTVVGHVDLAGSFNLGLAGVIFSFMLVNLFDSSGTLIGVTDKAGLADEKGKFPRMKQALYVDSISSVTGSFIGTSSVTAYIESSSGVSVGGRTGLTAVVVGLLFLLVIFLSPLAGMVPGYAAAGALIYVGVLMTSSLARVNWQDLTESVPAFITAVMMPFSFSITEGIALGFISYCVMKIGTGRLRDLSPCVIIVALLFILKIVFIDAH

SEQ ID NO: 1610 - protein, 313 aa, Escherichia coli
MNTFSQVWVFSDTPSRLPELMNGAQALANQINTFVLNDADGAQAIQLGANHVWKLNGKPDDRMIEDYAGVMADTIRQHGADGLVLLPNTRRGKLLAAKLGYRLKAAVSNDASTVSVQDGKATVKHMVYGGLAIGEERIATPYAVLTISSGTFDAAQPDASRTGETHTVEWQAPAVAITRTATQARQSNSVDLDKARLVVSVGRGIGSKENIALAEQLCKAIGAELACSRPVAENEKWMEHERYVGISNLMLKPELYLAVGISGQIQHMVGANASQTIFAINKDKNAPIFQYADYGIVGDAVKILPALTAALAR

SEQ ID NO: 1611 - protein, 228 aa, Escherichia coli
MSDNLPWKTWTPDDLAPPQAEFVPIVEPEETIIEEAEPSLEQQLAQLQMQAHEQGYQAGIAEGRQQGHKQGYQEGLAQGLEQGLAEAKSQQAPIHARMQQLVSEFQTTLDALDSVIASRLMQMALEAARQVIGQTPTVDNSALIKQIQQLLQQEPLFSGKPQLRVHPDDLQRVDDMLGATLSLHGWRLRGDPTLHPGGCKVSADEGDLDASVATRWQELCRLAAPGVV

SEQ ID NO: 1612 - protein, 300 aa, Escherichia coli
MLAFIRFLFAGLLLVISHAFAATVQDEHGTFTLEKTPQRIVVLELSFADALAAVDVIPIGIADDNDAKRILPEVRAHLKPWQSVGTRAQPSLEAIAALKPDLIIADSSRHAGVYIALQQIAPVLLLKSRNETYAENLQSAAIIGEMVGKKREMQARLEQHKERMAQWASQLPKGTRVAFGTSREQQFNLHTQETWTGSVLASLGLNVPAAMAGASMPSIGLEQLLAVNPAWLLVAHYREESIVKRWQQDPLWQMLTAAQKQQVASVDSNTWARMRGIFAAERIAADTVKIFHHQPLTVVK

SEQ ID NO: 1613 - protein, 300 aa, Escherichia coli
MNQSYGRLVSRAAIAATAMASLLLLIKIFAWWYTGSVSILAALVDSLVDIGASLTNLLVVRYSLQPADDNHSFGHGKAESLAALAQSMFISGSALFLFLTGIQHLISPTPMTDPGVGVIVTIVALICTIILVSFQRWVVRRTQSQAVRADMLHYQSDVMMNGAILLALGLSWYGWHRADALFALGIGIYILYSALRMGYEAVQSLLDRALPDEERQEIIDIVTSWPGVSGAHDLRTRQSGPTRFIQIHLEMEDSLPLVQAHMVADQVEQAILRRFPGSDVIIHQDPCSVVPREGKRSMLS

SEQ ID NO: 1614 - protein, 590 aa, Escherichia coli
MRLFAQLSWYFRREWRRYLGAVALLVIIAMLQLVPPKVVGIVVDGVTEQHFTTGQILMWIATMVLIAVVVYLLRYVWRVLLFGASYQLAVELREDYYRQLSRQHPEFYLRHRTGDLMARATNDVDRVVFAAGEGVLTLVDSLVMGCAVLIMMSTQISWQLTLFSLLPMPVMAIMIKRNGDALHERFKLAQAAFSSLNDRTQESLTSIRMIKAFGLEDRQSALFAADAEDTGKKNMRVARIDARFDPTIYIAIGMANLLAIGGGSWMVVQGSLTLGQLTSFMMYLGLMIWPMLALAWMFNIVERGSAAYSRIRAMLAEAPVVNDGSEPVPEGRGELDVNIHQFTYPQTDHPALENVNFALKPGQMLGICGPTGSGKSTLLSLIQRHFDVSEGDIRFHDIPLTKLQLDSWRSRLAVVSQTPFLFSDTVANNIALGCPNATQQEIEHVARLASVHDDILRLPQGYDTEVGERGVMLSGGQKQRISIARALLVNAEILILDDALSAVDGRTEHQILHNLRQWGQGRTVIISAHRLSALTEASEIIVMQHGHIAQRGNHDVLAQQSGWYRDMYRYQQLEAALDDAPENREEAVDA

SEQ ID NO: 1615 - protein, 365 aa, Escherichia coli
MSIEIANIKKSFGRTQVLNDISLDIPSGQMVALLGPSGSGKTTLLRIIAGLEHQTSGHIRFHGTDVSRLHARDRKVGFVFQHYALFRHMTVFDNIAFGLTVLPRRERPNAAAIKAKVTKLLEMVQLAHLADRYPAQLSGGQKQRVALARALAVEPQILLLDEPFGALDAQVRKELRRWLRQLHEELKFTSVFVTHDQEEATEVADRVVVMSQGNIEQADAPDQVWREPATRFVLEFMGEVNRLQGTIRGGQFHVGAHRWPLGYTPAYQGPVDLFLRPWEVDISRRTSLDSPLPVQVLEASPKGHYTQLVVQPLGWYNEPLTVVMHGDDAPQRGERLFVGLQHARLYNGDERIETRDEELALAQSA

SEQ ID NO: 1616 - protein, 343 aa, Escherichia coli
MIKLSNITKVFHQGTRTIQALNNVSLHVPAGQIYGVIGASGAGKSTLIRCVNLLERPTEGSVLVDGQELTTLSESELTKARRQIGMIFQHFNLLSSRTVFGNVALPLELDNTPKDEVKRRVTELLSLVGLGDKHDSYPSNLSGGQKQRVAIARALASNPKVLLCDEATSALDPATTRSILELLKDINRRLGLTILLITHEMDVVKRICDCVAVISNGELIEQDTVSEVFSHPKTPLAQKFIQSTLHLDIPEDYQERLQAEPFTDCVPMLRLEFTGQSVDAPLLSETARRFNVNNNIISAQMDYAGGVKFGIMLTEMHGTQQDTQAAIAWLQEHHVKVEVLGYV

SEQ ID NO: 1617 - protein, 225 aa, Escherichia coli
MTMLLPLFILVGFIADYFVNAIAYHLSPLEDKTALTFRQVLVHFRQKKYAWHDTVPLILCVAAAIACALAPFTPIVTGALFLYFCFVLTLSVIDFRTQLLPDKLTLPLLWLGLVFNAQYGLIDLHDAVYGAVAGYGVLWCVYWGVWLVCHKEGLGYGDFKLLAAAGAWCGWQTLPMILLIASLGGIGYAIVSQLLQRRTITTIAFGPWLALGSMINLGYLAWISY

SEQ ID NO: 1618 - protein, 175 aa, Escherichia coli
MNRFIIADASKCIGCRTCEVACVVSHQENQDCASLTPETFLPRIHVIKGVNISTATVCRQCEDAPCANVCPNGAISRDKGFVHVMQERCIGCKTCVVACPYGAMEVVVRPVIRNSGAGLNVRADKAEANKCDLCNHREDGPACMAACPTHALICVDRNKLEQLSAEKRRRTALMF

SEQ ID NO: 1619 - protein, 203 aa, Escherichia coli
MLTEQQRRELDWEKTDGLMPVIVQHAVSGEVLMLGYMNPEALDKTLESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQGLDLTTVIENLRKRHQ

SEQ ID NO: 1620 - protein, 231 aa, Escherichia coli
MITRDFLMNADCKTAFGAIEESLLWSAEQRAASLAATLACRPDEGPVWIFGYGSLMWNPALEFTESCTGTLVGWHRAFCLRLTAGRGTAHQPGRMLALKEGGRTTGVAYRLPEETLEQELTLLWKREMITGCYLPTWCQLDLDDGRTVNAIVFIMDPRHPEYESDTRAQVIAPLIAAASGPLGTNAQYLFSLEQELIKLGMQDDGLNDLLVSVKKLLAENFPDGVLRPGFA

SEQ ID NO: 1621 - protein, 1034 aa, Escherichia coli
MANFFIRRPIFAWVLAIILMMAGALAILQLPVAQYPTIAPPAVSVSANYPGADAQTVQDTVTQVIEQNMNGIDNLMYMSSTSDSAGSVTITLTFQSGTDPDIAQVQVQNKLQLATPLLPQEVQQQGISVEKSSSSYLMVAGFVSDNPGTTQDDISDYVASNVKDTLSRLNGVGDVQLFGAQYAMRIWLDADLLNKYKLTPVDVINQLKVQNDQIAAGQLGGTPALPGQQLNASIIAQTRFKNPEEFGKVTLRVNSDGSVVRLKDVARVELGGENYNVIARINGKPAAGLGIKLATGANALDTAKAIKAKLAELQPFFPQGMKVLYPYDTTPFVQLSIHEVVKTLFEAIMLVFLVMYLFLQNMRATLIPTIAVPVVLLGTFAILAAFGYSINTLTMFGMVLAIGLLVDDAIVVVENVERVMMEDKLPPKEATEKSMSQIQGALVGIAMVLSAVFIPMAFFGGSTGAIYRQFSITIVSAMALSVLVALILTPALCATLLKPVSAEHHENKGGFFGWFNTTFDHSVNHYTNSVGKILGSTGRYLLIYALIVAGMVVLFLRLPSSFLPEEDQGVFLTMIQLPAGATQERTQKVLDQVTDYYLKNEKANVESVFTVNGFSFSGQAQNAGMAFVSLKPWEERNGDENSAEAVIHRAKMELGKIRDGFVIPFNMPAIVELGTATGFDFELIDQAGLGHDALTQARNQLLGMAAQHPASLVSVRPNGLEDTAQFKLEVDQEKAQALGVSLSDINQTISTALGGTYVNDFIDRGRVKKLYVQADAKFRMLPEDVDKLYVRSANGEMVPFSAFTTSHWVYGSPRLERYNGLPSMEIQGEAAPGTSSGDAMALMENLASKLPAGIGYDWTGMSYQERLSGNQAPALVAISFVVVFLCLAALYESWSIPVSVMLVVPLGIVGVLLAATLFNQKNDVYFMVGLLTTIGLSAKNAILIVEFAKDLMEKEGKGVVEATLMAVRMRLRPILMTSLAFILGVLPLAISNGAGSGAQNAVGIGVMGGMVSATLLAIFFVPVFFVVIRRCFKG

SEQ ID NO: 1622 - protein, 1047 aa, Escherichia coli
MIEWIIRRSVANRFLVLMGALFLSIWGTWTIINTPVDALPDLSDVQVIIKTSYPGQAPQIVENQVTYPLTTTMLSVPGAKTVRGFSQFGDSYVYVIFEDGTDPYWARSRVLEYLNQVQGKLPAGVSAELGPDATGVGWIYEYALVDRSGKHDLADLRSLQDWFLKYELKTIPDVAEVASVGGVVKEYQVVIDPQRLAQYGISLAEVKSALDASNQEAGGSSIELAEAEYMVRASGYLQTLDDFNHIVLKASENGVPVYLRDVAKVQIGPEMRRGIAELNGEGEVAGGVVILRSGKNAREVIAAVKDKLETLKSSLPEGVEIVTTYDRSQLIDRAIDNLSGKLLEEFIVVAVVCALFLWHVRSALVAIISLPLGLCIAFIVMHFQGLNANIMSLGGIAIAVGAMVDAAIVMIENAHKRLEEWQHQHPDATLDNKTRWQVITDASVEVGPALFISLLIITLSFIPIFTLEGQEGRLFGPLAFTKTYAMAGAALLAIVVIPILMGYWIRGKIPPESSNPLNRFLIRVYHPLLLKVLHWPKTTLLVAALSVLTVLWPLNKVGGEFLPQINEGDLLYMPSTLPGISAAEAASMLQKTDKLIMSVPEVARVFGKTGKAETATDSAPLEMVETTIQLKPQEQWRPGMTMDKIIEELDNTVRLPGLANLWVPPIRNRIDMLSTGIKSPIGIKVSGTVLADIDAMAEQIEEVARTVPGVASALAERLEGGRYINVEINREKAARYGMTVADVQLFVTSAVGGAMVGETVEGIARYPINLRYPQSWRDSPQALRQLPILTPMKQQITLADVADIKVSTGPSMLKTENARPTSWIYIDARDRDMVSVVHDLQKAIAEKVQLKPGTSVAFSGQFELLERANHKLKLMVPMTLMIIFVLLYLAFRRVGEALLIISSVPFALVGGIWLLWWMGFHLSVATGTGFIALAGVAAEFGVVMLMYLRHAIEAVPSLNNPQTFSEQKLDEALYHGAVLRVRPKAMTVAVIIAGLLPILWGTGAGSEVMSRIAAPMIGGMITAPLLSLFIIPAAYKLMWLHRHRVRK

SEQ ID NO: 1623 - protein, 343 aa, Escherichia coli
MESTPKKAPRSKFPALLVVALALVALVFVIWRVDSAPSTNDAYASADTIDVVPEVSGRIVELAVTDNQAVKQGDLLFRIDPRPYEANLAKAEASLAALDKQIMLTQRSVDAQQFGADSVNATVEKARAAAKQATDTLRRTEPLLKEGFVSAEDVDRARTAQRAAEADLNAVLLQAQSAASAVSGVDALVAQRAAVEADIALTKLHLEMATVRAPFDGRVISLKTSVGQFASAMRPIFTLIDTRHWYVIANFRETDLKNIRSGTPATIRLMSDSGKTFEGKVDSIGYGVLPDDGGLVLGGLPKVSRSINWVRVAQRFPVKIMVDKPDPEMFRIGASAVANLEPQ

SEQ ID NO: 1624 - protein, 203 aa, Escherichia coli
MKKIAITCALLSSLVASSVWADAASDLKSRLDKVSSFHASFTQKVTDGSGAAVQEGQGDLWVKRPNLFNWHMTQPDESILVSDGKTLWFYNPFVEQATATWLKDATGNTPFMLIARNQSSDWQQYNIKQNGDDFVLTPKASNGNLKQFTINVGRDGTIHQFSAVEQDDQRSSYQLKSQQNGAVDAAKFTFTPPQGVTVDDQRK

SEQ ID NO: 1625 - protein, 445 aa, Escherichia coli
MHSQIWVVSTLLISIVLIVLTIVKFKFHPFLALLLASFFVGTMMGMGPLDMVNAIESGIGGTLGFLAAVIGLGTILGKMMEVSGAAERIGLTLQRCRWLSVDVIMVLVGLICGITLFVEVGVVLLIPLAFSIAKKTNTSLLKLAIPLCTALMAVHCVVPPHPAALYVANKLGADIGSVIVYGLLVGLMASLIGGPLFLKFLGQRLPFKPVPTEFADLKVRDEKTLPSLGATLFTILLPIALMLVKTIAELNMARESGLYILVEFIGNPITAMFIAVFVAYYVLGIRQHMSMGTMLTHTENGFGSIANILLIIGAGGAFNAILKSSSLADTLAVILSNMHMHPILLAWLVALILHAAVGSATVAMMGATAIVAPMLPLYPDISPEIIAIAIGSGAIGCTIVTDSLFWLVKQYCGATLNETFKYYTTATFIASVVALAGTFLLSFII

SEQ ID NO: 1626 - protein, 663 aa, Escherichia coli
MFGKLSLDAVPFHEPIVMVTIAGIILGGLALVGLITYFGKWTYLWKEWLTSVDHKRLGIMYIIVAIVMLLRGFADAIMMRSQQALASAGEAGFLPPHHYDQIFTAHGVIMIFFVAMPFVIGLMNLVVPLQIGARDVAFPFLNNLSFWFTVVGVILVNVSLGVGEFAQTGWLAYPPLSGIEYSPGVGVDYWIWSLQLSGIGTTLTGINFFVTILKMRAPGMTMFKMPVFTWASLCANVLIIASFPILTVTVALLTLDRYLGTHFFTNDMGGNMMMYINLIWAWGHPEVYILILPVFGVFSEIAATFSRKRLFGYTSLVWATVCITVLSFIVWLHHFFTMGAGANVNAFFGITTMIIAIPTGVKIFNWLFTMYQGRIVFHSAMLWTIGFIVTFSVGGMTGVLLAVPGADFVLHNSLFLIAHFHNVIIGGVVFGCFAGMTYWWPKAFGFKLNETWGKRAFWFWIIGFFVAFMPLYALGFMGMTRRLSQQIDPQFHTMLMIAASGAVLIALGILCLVIQMYVSIRDRDQNRDLTGDPWGGRTLEWATSSPPPFYNFAVVPHVHERDAFWEMKEKGEAYKKPDHYEEIHMPKNSGAGIVIAAFSTIFGFAMIWHIWWLAIVGFAGMIITWIVKSFDEDVDYYVPVAEIEKLENQHFDEITKAGLKNGN

SEQ ID NO: 1627 - protein, 428 aa, Escherichia coli
MSEDIFDAIIVGAGLAGSVAALVLAREGAQVLVIERGNSAGAKNVTGGRLYAHSLEHIIPGFADSAPVERLITHEKLAFMTEKSAMTMDYCNGDETSPSQRSYSVLRSKFDAWLMEQAEEAGAQLITGIRVDNLVQRDGKVVGVEADGDVIEAKTVILADGVNSILAEKLGMAKRVKPTDVAVGVKELIELPKSVIEDRFQLQGNQGAACLFAGSPTDGLMGGGFLYTNENTLSLGLVCGLHHLHDAKKSVPQMLEDFKQHPAVAPLIAGGKLVEYSAHVVPEAGINMLPELVGDGVLIAGDAAGMCMNLGFTIRGMDLAIAAGEAAAKTVLSAMKSDDFSKQKLAEYRQHLESGPLRDMRMYQKLPAFLDNPRMFSGYPELAVGVARDLFTIDGSAPELMRKKILRHGKKVGFINLIKDGMKGVTVL

SEQ ID NO: 1628 - protein, 98 aa, Escherichia coli
MEGKNKFNTYVVSFDYPSSYSSVFLRLRSLMYDMNFSSIVADEYGIPRQLNENSFAITTSLAASEIEDLIRLKCLDLPDIDFDLNIMTVDDYFRQFYK

SEQ ID NO: 1629 - protein, 173 aa, Escherichia coli
MSDRATTTASLTFESLYGTHHGWLKSWLTRKLQSAFDADDIAQDTFLRVMVSETLSTIRDPRSFLCTIAKRVMVDLFRRNALEKAYLEMLALMPEGGAPSPEERESQLETLQLLDSMLDGLNGKTREAFLLSQLDGLTYSEIAHKLGVSISSVKKYVAKAVEHCLLFRLEYGL

SEQ ID NO: 1630 - protein, 432 aa, Escherichia coli
MRKIKGLRWYMIALVTLGTVLGYLTRNTVAAAAPTLMEELNISTQQYSYIIAAYSAAYTVMQPVAGYVLDVLGTKIGYAMFAVLWAVFCGATALAGSWGGLAVARGAVGAAEAAMIPAGLKASSEWFPAKERSIAVGYFNVGSSIGAMIAPPLVVWAIVMHSWQMAFIISGALSFIWAMAWLIFYKHPRDQKHLTDEERDYIINGQEAQHQVSTAKKMSVGQILRNRQFWGIALPRFLAEPAWGTFNAWIPLFMFKVYGFNLKEIAMFAWMPMLFADLGCILGGYLPPLFQRWFGVNLIVSRKMVVTLGAVLMIGPGMIGLFTNPYVAIMLLCIGGFAHQALSGALITLSSDVFGRNEVATANGLTGMSAWLASTLFALVVGALADTIGFSPLFAVLAVFDLLGALVIWTVLQNKPAIEVAQETHNDPAPQH

SEQ ID NO: 1631 - protein, 167 aa, Escherichia coli
MATAGMLLKLNSQMNREFYASNLYLHLSNWCSEQSLNGTATFLRAQAQSNVTQMMRMFNFMKSVGATPIVKAIDVPGEKLNSLEELFQKTMEEYEQRSSTLAQLADEAKELNDDSTVNFLRDLEKEQQHDGLLLQTILDEVRSAKLAGMCPVQTDQHVLNVVSHQLH

SEQ ID NO: 1632 - protein, 319 aa, Escherichia coli
MAQRDYVRRSQPAPSRRKKSTSRKKQRNLPAVSPAMVAIAAAVLVTFIGGLYFITHHKKEESETLQSQKVTGNGLPPKPEERWRYIKELESRQPGVRAPTEPSAGGEVKTPEQLTPEQRQLLEQMQADMRQQPTQLVEVPWNEQTPEQRQQTLQRQRQAQQLAEQQRLAQQSRTTEQSWQQQTRTSQAAPVQAQPRQSKPASSQQPYQDLLQTPAHTTAQSKPQQAAPVARAADAPKPTAEKKDERRWMVQCGSFRGAEQAETVRAQLAFEGFDSKITTNNGWNRVVIGPVKGKENADSTLNRLKMAGHTNCIRLAAGG

SEQ ID NO: 1633 - protein, 211 aa, Escherichia coli
MKRRDTIVRYTAPERINHWITAFCFILAAVSGLGFLFPSFNWLMQIMGTPQLARILHPFVGVVMFASFIIMFFRYWHHNLINRDDIFWAKNIRKIVVNEEVGDTGRYNFGQKCVFWAAIIFLVLLLVSGVIIWRPYFAPAFSIPVIRFALMLHSFAAVALIVVIMVHIYAALWVKGTITAMVEGWVTSAWAKKHHPRWYREVRKTTEKKAE

SEQ ID NO: 1634 - protein, 334 aa, Escherichia coli
MSTQEATLQQPLLQAIDLKKHYPVKKGMFAPERLVKALDGVSFNLERGKTLAVVGESGCGKSTLGRLLTMIEMPTGGELYYQGQDLLKHDPQAQKLRRQKIQIVFQNPYGSLNPRKKVGQILEEPLLINTSLSKEQRREKALSMMAKVGLKTEHYDRYPHMFSGGQRQRIAIARGLMLDPDVVIADEPVSALDVSVRAQVLNLMMDLQQELGLSYVFISHDLSVVEHIADEVMVMYLGRCVEKGTKDQIFNNPRHPYTQALLSATPRLNPDDRRERIKLSGELPSPLNPPPGCAFNARCRRRFGPCTQLQPQLKDYGGQLVACFAVDQDENPQR

SEQ ID NO: 1635 - protein, 512 aa, Escherichia coli
MQQQKPLEGAQLVIMTIALSLATFMQVLDSTIANVAIPTIAGNLGSSLSQGTWVITSFGVANAISIPLTGWLAKRVGEVKLFLWSTIAFAIASWACGVSSSLNMLIFFRVIQGIVAGPLIPLSQSLLLNNYPPAKRSIALALWSMTVIVAPICGPILGGYISDNYHWGWIFFINVPIGVAVVLMTLQTLRGRETRTERRRIDAVGLALLVIGIGSLQIMLDRGKELDWFSSQEIIILTVVAVVAICFLIVWELTDDNPIVDLSLFKSRNFTIGCLCISLAYMLYFGAIVLLPQLLQEVYGYTATWAGLASAPVGIIPVILSPIIGRFAHKLDMRRLVTFSFIMYAVCFYWRAYTFEPGMDFGASAWPQFIQGFAVACFFMPLTTITLSGLPPERLAAASSLSNFTRTLAGSIGTSITTTMWTNRESMHHAQLTESVNPFNPNAQAMYSQLEGLGMTQQQASGWIAQQITNQGLIISANEIFWMSAGIFLVLLGLVWFAKPPFGAGGGGGGAH

SEQ ID NO: 1636 - protein, 330 aa, Escherichia coli
MIYVSRRLLITCLLLVSACVVAGIWGLRSGAVTLETSQVFAALMGDAPRSMTMVVTEWRLPRVLMALLIGAALGVSGAIFQSLMRNPLGSPDVMGFNTGAWSGVLVAMVLFGQDLTAIALSAMVGGIVTSLLVWLLAWRNGIDTFRLIIIGIGVRAMLVAFNTWLLLKASLETALTAGLWNAGSLNGLTWAKTSPSAPIIILMLIAAALLVRRMRLLEMGDDTACALGVSVERSRLLMMLVAVVLTAAATALAGPISFIALVAPHIARRISGTARWGLTQAALCGALLLLAADLCAQQLFMPYQLPVGVVTVSLGGIYLIVLLIQESRKK

SEQ ID NO: 1637 - protein, 282 aa, Escherichia coli
MRNKLSFDLQLSARKAAIAERIAAHKIARSKVSVFLMAMSAGVFMAIGFTFYLSVIADAPSSQALTHLVGGLCFTLGFILLAVCGTSLFTSSVMTVMAKSRGVISWRTWLINALLVACGNLAGIACFSLLIWFSGLVMSENAMWGVAVLHCAEGKMHHTFTESVSLGIMCNLMVCLALWMSYCGRSLCDKIVAMILPITLFVASGFEHCIANLFVIPFAIAIRHFAPPPFWQLAHSSADNFPALTVSHFITANLLPVMLGNIIGGAVLVSMCYRAIYLRQEP

SEQ ID NO: 1638 - protein, 245 aa, Escherichia coli
MRRLLSVAPVLLWLITPLAFAQLPGITSQPLPGGGQSWSLPVQTLVFITSLTFIPAILLMMTSFTRIIIVFGLLRNALGTPSAPPNQVLLGLALFLTFFIMSPVIDKIYVDAYQPFSEEKISMQEALEKGAQPLREFMLRQTREADLGLFARLANTGPLQGPEAVPMRILLPAYVTSELKTAFQIGFTIFIPFLIIDLVIASVLMALGMMMVPPATIALPFKLMLFVLVDGWQLLVGSLAQSFYS

SEQ ID NO: 1639 - protein, 300 aa, Escherichia coli
MAYQSQDIIRRSATNGLTPAPQARDFQEEVAKLIDVTTCIGCKACQVACSEWNDIRDTVGNNIGVYDNPNDLSAKSWTVMRFSEVEQNDKLEWLIRKDGCMHCSDPGCLKACPAEGAIIQYANGIVDFQSEQCIGCGYCIAGCPFDIPRLNPEDNRVYKCTLCVDRVVVGQEPACVKTCPTGAIHFGTKESMKTLASERVAELKTRGYDNAGLYDPAGVGGTHVMYVLHHADKPNLYHGLPENPEISETVKFWKGIWKPLAAVGFAATFAASIFHYVGVGPNRADEEENNLHEEKDEERK

SEQ ID NO: 1640 - protein, 147 aa, Escherichia coli
MAEHGALATLKDLAEKEVEDAARLLGEMRRGCQQAEEQLKMLIDYQNEYRNNLNSDMSAGITSNRWINYQQFIQTLEKAITQHRQQLNQWTQKVDIALNSWREKKQRLQAWQTLQERQSTAALLAENRLDQKKMDEFAQRAAMRKPE

SEQ ID NO: 1641 - protein, 420 aa, Escherichia coli
MKTLIARHKAGEHIGICSVCSAHPLVIEAALAFDRNSTRKVLIEATSNQVNQFGGYTGMTPADFREFVFTIADKVGFARERIILGGDHLGPNCWQQENADAAMEKSVELVKEYVRAGFSKIHLDASMSCAGDPIPLAPETVAERAAVLCFAAESVATDCQREQLSYVIGTEVPVPGGEASAIQSVHITHVEDAANTLRTHQKAFIARGLTEALTRVIAIVVQPGVEFDHSNIIHYQPQEAQPLAQWIENTRMVYEAHSTDYQTRTAYWELVRDHFAILKVGPALTFALREAIFALAQIEQELIAPENRSGCLAVIEEVMLDEPQYWKKYYRTGFNDSLLDIRYSLSDRIRYYWPHSRIKNSVETMMVNLEGVDIPLGMISQYLPKQFERIQSGELSAIPHQLIMDKIYDVLRAYRYGCAE

SEQ ID NO: 1642 - protein, 217 aa, Escherichia coli
MSKSKMIVRTKFIDRACHWTVVICFFLVALSGISFFFPTLQWLTQTFGTPQMGRILHPFFGIAIFVALMFMFVRFVHHNIPDKKDIPWLLNIVEVLKGNEHKVADVGKYNAGQKMMFWSIMSMIFVLLVTGVIIWRPYFAQYFPMQVVRYSLLIHAAAGIILIHAILIHMYMAFWVKGSIKGMIEGKVSRRWAKKHHPRWYREIEKAEAKKESEEGI

SEQ ID NO: 1643 - protein, 281 aa, Escherichia coli
MSQTSTLKGQCIAEFLGTGLLIFFGVGCVAALKVAGASFGQWEISVIWGLGVAMAIYLTAGVSGAHLNPAVTIALWLFACFDKRKVIPFIVSQVAGAFCAAALVYGLYYNLFFDFEQTHHIVRGSVESVDLAGTFSTYPNPHINFVQAFAVEMVITAILMGLILALTDDGNGVPRGPLAPLLIGLLIAVIGASMGPLTGFAMNPARDFGPKVFAWLAGWGNVAFTGGRDIPYFLVPLFGPIVGAIVGAFAYRKLIGRHLPCDICVVEEKETTTPSEQKASL

SEQ ID NO: 1644 - protein, 105 aa, Escherichia coli
MSWIILVIAGLLEVVWAVGLKYTHGFSRLTPSVITVTAMIVSMALLAWAMKSLPVGTAYAVWTGIGAVGAAITGIVLLGESANPMRLASLALIVLGIIGLKLSTH

SEQ ID NO: 1645 - protein, 287 aa, Escherichia coli
MGSGWHEWPLMIFTVFGQCVAGGFIVLALALLKGDLRAEAQQRVIACMFGLWVLMGIGFIASMLHLGSPMRAFNSLNRVGASALSNEIASGSIFFAVGGIGWLLAMLKKLSPALRTLWLIVTMVLGVIFVWMMVRVYNSIDTVPTWYSIWTPMGFFLTMFMGGPLLGYLLLSLAGVDGWAMRLLPAISVLALVVSGVVSVMQGAELATIHSSVQQAAALVPDYGALMSWRIVLLAVALCLWIAPQLKGYQPAVPLLSVSFILLLAGELIGRGVFYGLHMTVGMAVAS

SEQ ID NO: 1646 - protein, 303 aa, Escherichia coli
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 1647 - protein, 394 aa, Escherichia coli
MKKVILSLALGTFGLGMAEFGIMGVLTELAHNVGISIPAAGHMISYYALGVVVGAPIIALFSSRYSLKHILLFLVALCVIGNAMFTLSSSYLMLAIGRLVSGFPHGAFFGVGAIVLSKIIKPGKVTAAVAGMVSGMTVANLLGIPLGTYLSQEFSWRYTFLLIAVFNIAVMASVYFWVPDIRDEAKGNLREQFHFLRSPAPWLIFAATMFGNAGVFAWFSYVKPYMMFISGFSETAMTFIMMLVGLGMVLGNMLSGRISGRYSPLRIAAVTDFIIVLALLMLFFCGGMKTTSLIFAFICCAGLFALSAPLQILLLQNAKGGELLGAAGGQIAFNLGSAVGAYCGGMMLTLGLAYNYVALPAALLSFAAMSSLLLYGRYKRQQAADTPVLAKPLG

SEQ ID NO: 1648 - protein, 297 aa, Escherichia coli
MKRPDYRTLQALDAVIRERGFERAAQKLCITQSAVSQRIKQLENMFGQPLLVRTVPPRPTEQGQKLLALLRQVELLEEEWLGDEQTGSTPLLLSLAVNADSLATWLLPALAPVLADSPIRLNLQVEDETRTQERLRRGEVVGAVSIQHQALPSCLVDKLGALDYLFVSSKPFAEKYFPNGVTRSALLKAPVVAFDHLDDMHQAFLQQNFDLPPGSVPCHIVNSSEAFVQLARQGTTCCMIPHLQIEKELASGELIDLTPGLFQRRMLYWHRFAPESRMMRKVTDALLDYGHKVLRQD

SEQ ID NO: 1649 - protein, 440 aa, Escherichia coli
MIGRISRFMTRFVSRWLPDPLIFAMLLTLLTFVIALWLTPQTPISMVKMWGDGFWNLLAFGMQMALIIVTGHALASSAPVKSLLRTAASAAKTPVQGVMLVTFFGSVACVINWGFGLVVGAMFAREVARRVPGSDYPLLIACAYIGFLTWGGGFSGSMPLLAATPGNPVEHIAGLIPVGDTLFSGFNIFITVALIVVMPFITRMMMPKPSDVVSIDPKLLMEEADFQKQLPKDAPPSERLEESRILTLIIGALGIAYLAMYFSEHGFNITINTVNLMFMIAGLLLHKTPMAYMRAISAAARSTAGILVQFPFYAGIQLMMEHSGLGGLITEFFINVANKDTFPVMTFFSSALINFAVPSGGGHWVIQGPFVIPAAQALGADLGKSVMAIAYGEQWMNMAQPFWALPALAIAGLGVRDIMGYCITALLFSGVIFVIGLTLF

SEQ ID NO: 1650 - protein, 112 aa, Escherichia coli
MTMNSFERRNKIIQLVNEQGTVLVQDLAGVFAASEATIRADLRFLEQKGVVTRFHGGAAKIMSGNSETETQEVGFKERFQLASAPKNRIAQAAVKMIHEGMTDPTHVIWTQA

SEQ ID NO: 1651 - protein, 444 aa, Escherichia coli
MNNDNTDYVSNESGTLSRLFKLPQHGTTVRTELIAGMTTFLTMVYIVFVNPQILGAAQMDPKVVFVTTCLIAGIGSIAMGIFANLPVALAPAMGLNAFFAFVVVGAMGISWQTGMGAIFWGAVGLFLLTLFRIRYWMISNIPLSLRIGITSGIGLFIALMGLKNTGVIVANKDTLVMIGDLSSHGVLLGILGFFIITVLSSRHFHAAVLVSIVVTSCCGLFFGDVHFSGVYSIPPDISGVIGEVDLSGALTLELAGIIFSFMLINLFDSSGTLIGVTDKAGLIDGNGKFPNMNKALYVDSVSSVAGAFIGTSSVTAYIESTSGVAVGGRTGLTAVVVGVMFLLVMFFSPLVAIVPPYATAGALIFVGVLMTSSLARVNWDDFTESVPAFITTVMMPFTFSITEGIALGFMSYCIMKVCTGRWRDLNLCVVVVAALFALKIILVD

SEQ ID NO: 1652 - protein, 614 aa, Escherichia coli
MIKKASLLTACSVTAFSAWAQDTSPDTLVVTANRFEQPRSTVLAPTTVVTRQDIDRWQSTSVNDVLRRLPGVDITQNGGSGQLSSIFIRGTNASHVLVLIDGVRLNLAGVSGSADLSQFPIALVQRVEYIRGPRSAVYGSDAIGGVVNIITTRDEPGTEISAGWGSNSYQNYDVSTQQQLGDKTRVTLLGDYAHTHGYDVVAYGNTGTQAQTDNDGFLSKTLYGALEHNFTDAWSGFVRGYGYDNRTNYDAYYSPGSPLLDTRKLYSQSWDAGLRYNGELIKSQLITSYSHSKDYNYDPHYGRYDSSATLDEMKQYTVQWANNVIVGHGSIGAGVDWQKQTTTPGTGYVEDGYDQRNTGIYLTGLQQVGDFTFEGAARSDDNSQFGRHGTWQTSAGWEFIEGYRFIASYGTSYKAPNLGQLYGFYGNPNLDPEKSKQWEGAFEGLTAGVNWRISGYRNDVSDLIDYDDHTLKYYNEGKARIKGVEATANFDTGPLTHTVSYDYVDARNAITDTPLLRRAKQQVKYQLDWQLYDFDWGITYQYLGTRYDKDYSSYPYQTVKMGGVSLWDLAVAYPVTSHLTVRGKIANLFDKDYETVYGYQTAGREYTLSGSYTF

SEQ ID NO: 1653 - protein, 538 aa, Escherichia coli
MFRRNLITSAILLMAPLAFSAQSLAESLTVEQRLELLEKALRETQSELKKYKDEEKKKYTPATVNRSVSTNDQGYAANPFPTSSAAKPDAVLVKNEEKNASETGSIYSSMTLKDFSKFVKDEIGFSYNGYYRSGWGTASHGSPKSWAIGSLGRFGNEYSGWFDLQLKQRVYNENGKRVDAVVMMDGNVGQQYSTGWFGDNAGGENYMQFSDMYVTTKGFLPFAPEADFWVGKHGAPKIEIQMLDWKTQRTDAAAGVGLENWKVGPGKIDIALVREDVDDYDRSLQNKQQINTNTIDLRYKDIPLWDKATLMVSGRYVTANESASEKDNQDNNGYYDWKDTWMFGTSLTQKFDKGGFNEFSFLVANNSIASNFGRYAGASPFTTFNGRYYGDHTGGTAVRLTSQGEAYIGDHFIVANAIVYSFGNDIYSYETGAHSDFESIRAVVRPAYIWDQYNQTGVELGYFTQQNKDANSNKFNESGYKTTLFHTFKVNTSMLTSRPEIRFYATYIKALENELDGFTFEDNKDDQFAVGAQAEIWW

SEQ ID NO: 1654 - protein, 356 aa, Escherichia coli
MKKLINDVQDVLDEQLAGLAKAHPSLTLHQDPVYVTRADAPVAGKVALLSGGGSGHEPMHCGYIGQGMLSGACPGEIFTSPTPDKIFECAMQVDGGEGVLLIIKNYTGDILNFETATELLHDSGVKVTTVVIDDDVAVKDSLYTAGRRGVANTVLIEKLVGAAAERGDSLDACAELGRKLNNQGHSIGIALGACTVPAAGKPSFTLADNEMEFGVGIHGEPGIDRRPFSSLDQTVDEMFDTLLVNGSYHRTLRFWDYQQGSWQEEQQTKQPLQSGDRVIALVNNLGATPLSELYGVYNRLTTRCQQAGLTIERNLIGAYCTSLDMTGFSITLLKVDDETLALWDAPVHTPALNWGK

SEQ ID NO: 1655 - protein, 292 aa, Escherichia coli
MAEAQNDPLLPGYSFNAHLVAGLTPIEANGYLDFFIDRPLGMKGYILNLTIRGQGVVKNQGREFVCRPGDILLFPPGEIHHYGRHPEAREWYHQWVYFRPRAYWHEWLNWPSIFANTGFFRPDEAHQPHFSDLFGQIINAGQGEGRYSELLAINLLEQLLLRRMEAINESLHPPMDNRVREACQYISDHLADSNFDIASVAQHVCLSPSRLSHLFRQQLGISVLSWREDQRISQAKLLLSTTRMPIATVGRNVGFDDQLYFSRVFKKCTGASPSEFRAGCEEKVNDVAVKLS

SEQ ID NO: 1656 - protein, 423 aa, Escherichia coli
MQYKDENGVNEPSRRRLLKVIGALALAGSCPVAHAQKTQSAPGTLSPDARNEKQPFYGEHQAGILTPQQAAMMLVAFDVLASDKADLERLFRLLTQRFAFLTQGGAAPETPNPRLPPLDSGILGGYIAPDNLTITLSVGHSLFDERFGLAPQMPKKLQKMTRFPNDSLDAALCHGDVLLQICANTQDTVIHALRDIIKHTPDLLSVRWKREGFISDHAARSKGKETPINLLGFKDGTANPDSQNDKLMQKVVWVTADQQEPAWTIGGSYQAVRLIQFRVEFWDRTPLKEQQTIFGRDKQTGAPLGMQHEHDVPDYASDPEGKVIALDSHIRLANPRTAESESSLMLRRGYSYSLGVTNSGQLDMGLLFVCYQHDLEKGFLTVQKRLNGEALEEYVKPIGGGYFFALPGVKDANDYFGSALLRV

SEQ ID NO: 1657 - protein, 240 aa, Escherichia coli
MIEFKNVSKHFGPTQVLHNIDLNIAQGEVVVIIGPSGSGKSTLLRCINKLEEITSGDLIVDGLKVNDPKVDERLIRQEAGMVFQQFYLFPHLTALENVMFGPLRVRGANKEEAEKLARELLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGNPQVLIKNPPSQRLQEFLQHVS

SEQ ID NO: 1658 - protein, 407 aa, Escherichia coli
MKKIALIIGSMIAGGIISAAGFTWVAKAEPPAEKTSTAERKILFWYDPMYPNTRFDKPGKSPFMDMDLVPKYADEESSASGVRIDPTQTQNLGVKTATVTRGPLTFAQSFPANVSYNEYQYAIVQARAAGFIDKVYPLTVGDKVQKGTPLLDLTIPDWVEAQSEYLLLRETGGTATQTEGILERLRLAGMPEADIRRLIATQKIQTRFTLKAPIDGVITAFDLRAGMNIAKDNVVAKIQGMDPVWVTAAIPESIAWLVKDASQFTLTVPARPDKTLTIRKWTLLPGVDAATRTLQLRLEVDNADEALKPGMNAWLQLNTASEPMLLIPSQALIDTGSEQRVITVDADGRFVPKRVAVFQASQGVTALRSGLAEGEKVVSSGLFLIDSEANISGALERMRSESATHAH

SEQ ID NO: 1659 - protein, 760 aa, Escherichia coli
MENNRNFPARQFHSLTFFAGLCIGITPVAQALAAEGQTNADDTLVVEASTPSLYAPQQSADPKFSRPVADTTRTMTVISEQVIKDQGATNLTDALKNVPGVGAFFAGENGNSTTGDAIYMRGADTSNSIYIDGIRDIGSVSRDTFNTEQVEVIKGPSGTDYGRSAPTGSINMISKQPRNDSGIDASASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGKVDTHNFYGTDSDYDDSTTDTATMRFEHDINDNTTIRNTTRWSRVKQDYLMTAIMGGASNITQPTSDVNSWTWSRTANTKDVSNKILTNQTNLTSTFYTGSIGHDVSTGVEFTRETQTNYGVNPVTLPAVNIYHPDSSIHPGGLTRNGANANGQTDTFAIYAFDTLQITRDFELNGGIRLDNYHTEYDSATACGGSGRGAITCPTGVAKGSPVTTVDTAKSGNLMNWKAGALYHLTENGNVYINYAVSQQPPGGNNFALAQSGSGNSANRTDFKPQKANTSEIGTKWQVLDKRLLLTAALFRTDIENEVEQNDDGTYSQYGKKRVEGYEISVAGNITPAWQVIGGYTQQKATIKNGKDVAQDGSSSLPYTPEHAFTLWSQYQATDDISVGAGARYIGSMHKGSDGAVGTPAFTEGYWVADAKLGYRVNRNLDFQLNVYNLFDTDYVASINKSGYRYHPGEPRTFLLTANMHF

SEQ ID NO: 1660 - protein, 265 aa, Escherichia coli
MQEYTNHSDTTFALRNISFRVPGRTLLHPLSLTFPAGKVTGLIGHNGSGKSTLLKMLGRHQPPSEGEILLDAQPLESWSSKAFARKVAYLPQQLPPAEGMTVRELVAIGRYPWHGALGRFGAADREKVEEAISLVGLKPLAHRLVDSLSGGERQRAWIAMLVAQDSRCLLLDEPTSALDIAHQVDVLSLVHRLSQERGLTVIAVLHDINMAARYCDYLVALRGGEMIAQGTPAEIMRGETLEMIYGIPMGILPHPAGAAPVSFVY

SEQ ID NO: 1661 - protein, 602 aa, Escherichia coli
MQTFQADLAIVGAGGAGLRAAIAAAQANPNAKIALISKVYPMRSHTVAAEGGSAAVAQDHDSFEYHFHDTVAGGDWLCEQDVVDYFVHHCPTEMTQLELWGCPWSRRPDGSVNVRRFGGMKIERTWFAADKTGFHMLHTLFQTSLQFPQIQRFDEHFVLDILVDDGHVRGLVAMNMMEGTLVQIRANAVVMATGGAGRVYRYNTNGGIVTGDGMGMALSHGVPLRDMEFVQYHPTGLPGSGILMTEGCRGEGGILVNKNGYRYLQDYGMGPETPLGEPKNKYMELGPRDKVSQAFWHEWRKGNTISTPRGDVVYLDLRHLGEKKLHERLPFICELAKAYVGVDPVKEPIPVRPTAHYTMGGIETDQNCETRIKGLFAVGECSSVGLHGANRLGSNSLAELVVFGRLAGEQATERAATAGNGNEAAIEAQAAGVEQRLKDLVNQDGGENWAKIRDEMGLAMEEGCGIYRTPELMQKTIDKLAELQERFKRVRITDTSSVFNTDLLYTIELGHGLNVAECMAHSAMARKESRGAHQRLDEGCTERDDVNFLKHTLAFRDADGTTRLEYSDVKITTLPPAKRVYGGEADAADKAEAANKKEKANG

SEQ ID NO: 1662 - protein, 126 aa, Escherichia coli
MSVSLVSRNVARKLLLVQLLVVIASGLLFSLKDPFWGVSAISGGLAVFLPNVLFMIFAWRHQAHTPAKGRVAWTFAFGEAFKVLAMLVLLVVALAVLKAVFLPLIVTWVLVLVVQILAPAVINNKG

SEQ ID NO: 1663 - protein, 233 aa, Escherichia coli
MTTLSCKVTSVEAITDTVYRVRIVPDAAFSFRAGQYLMVVMDERDKRPFSMASTPDEKGFIELHIGASEINLYAKAVMDRILKDHQIVVDIPHGEAWLRDDEERPMILIAGGTGFSYARSILLTALARNPNRDITIYWGGREEQHLYDLCELEALSLKHPGLQVVPVVEQPEAGWRGRTGTVLTAVLQDHGTLAEHDIYIAGRFEMAKIARDLFCSERNAREDRLFGDAFAFI

SEQ ID NO: 1664 - protein, 173 aa, Escherichia coli
MNMGLFYGSSTCYTEMAAEKIRDIIGPELVTLHNLKDDSPKLMEQYDVLILGIPTWDFGEIQEDWEAVWDQLDDLNLEGKIVALYGLGDQLGYGEWFLDALGMLHDKLSTKGVKFVGYWPTEGYEFTSPKPVIADGQLFVGLALDETNQYDLSDERIQSWCEQILNEMAEHYA

SEQ ID NO: 1665 - protein, 438 aa, Escherichia coli
MGNTSIQTQSYRAVDKDAGQSRSYIIPFALLCSLFFLWAVANNLNDILLPQFQQAFTLTNFQAGLIQSAFYFGYFIIPIPAGILMKKLSYKAGIITGLFLYALGAALFWPAAEIMNYTLFLVGLFIIAAGLGCLETAANPFVTVLGPESSGHFRLNLAQTFNSFGAIIAVVFGQSLILSNVPHQSQDVLDKMSPEQLSAYKHSLVLSVQTPYMIIVAIVLLVALLIMLTKFPALQSDNHSDAKQGSFSASLSRLARIRHWRWAVLAQFCYVGAQTACWSYLIRYAVEEIPGMTAGFAANYLTGTMVCFFIGRFTGTWLISRFAPHKVLAAYALIAMALCLISAFAGGHVGLIALTLCSAFMSIQYPTIFSLGIKNLGQDTKYGSSFIVMTIIGGGIVTPVMGFVSDAAGNIPTAELIPALCFAVIFIFARFRSQTATN

SEQ ID NO: 1666 - protein, 716 aa, Escherichia coli
MALTAALKAQIAAWYKALQEQIPDFIPRAPQRQMIADVAKTLAGEEGRHLAIEAPTGVGKTLSYLIPGIAIAREEQKTLVVSTANVALQDQIYSKDLPLLKKIIPDLKFTAAFGRGRYVCPRNLTALASTEPTQQDLLAFLDDELTPNNQEEQKRCAKLKGDLDTYKWDGLRDHTDIAIDDDLWRRLSTDKASCLNRNCYYYRECPFFVARREIQEAEVVVANHALVMAAMESEAVLPDPKNLLLVLDEGHHLPDVARDALEMSAEITAPWYRLQLDLFTKLVATCMEQFRPKTIPPLAIPERLNAHCEELYELIASLNNILNLYMPAGQEAEHRFAMGELPDEVLEICQRLAKLTEMLRGLAELFLNDLSEKTGSHDIVRLHRLILQMNRALGMFEAQSKLWRLASLAQSSGAPVTKWATREEREGQLHLWFHCVGIRVSDQLERLLWRSIPHIIVTSATLRSLNSFSRLQEMSGLKEKAGDRFVALDSPFNHCEQGKIVIPRMRVEPSIDNEEQHIAEMAAFFRKQVESKKHLGMLVLFASGRAMQRFLDYVTDLRLMLLVQGDQPRYRLVELHRKRVANGERSVLVGLQSFAEGLDLKGDLLSQVHIHKIAFPPIDSPVVITEGEWLKSLNRYPFEVQSLPSASFNLIQQVGRLIRSHGCWGEVVIYDKRLLTKNYGKRLLDALPVFPIEQPEVPEGIVKKKEKTKSPRRRRR

SEQ ID NO: 1667 - protein, 211 aa, Escherichia coli
MFSYYFQGLALGAAMILPLGPQNAFVMNQGIRRQYHIMIALLCAISDLVLICAGIFGGSALLMQSPWLLALVTWGGVAFLLWYGFGAFKTAMSSNIELASAEVMKQGRWKIIATMLAVTWLNPHVYLDTFVVLGSLGGQLDVEPKRWFALGTISASFLWFFGLALLAAWLAPRLRTAKAQRIINLVVGCVMWFIALQLARDGIAHAQALFS

SEQ ID NO: 1668 - protein, 701 aa, Escherichia coli
MNKSGKYLVWTVLSVMGAFALGYIALNRGEQINALWIVVASVCIYLIAYRFYGLYIAKNVLAVDPTRMTPAVRHNDGLDYVPTDKKVLFGHHFAAIAGAGPLVGPVLAAQMGYLPGMIWLLAGVVLAGAVQDFMVLFVSTRRDGRSLGELVKEEMGPTAGVIALVACFMIMVIILAVLAMIVVKALTHSPWGTYTVAFTIPLALFMGIYLRYLRPGRIGEVSVIGLVFLIFAIISGGWVAESPTWAPYFDFTGVQLTWMLVGYGFVAAVLPVWLLLAPRDYLSTFLKIGTIVGLAVGILIMRPTLTMPALTKFVDGTGPVWTGNLFPFLFITIACGAVSGFHALISSGTTPKMLANEGQACFIGYGGMLMESFVAIMALVSACIIDPGVYFAMNSPMAVLAPAGTADVVASAAQVVSSWGFSITPDTLNQIASEVGEQSIISRAGGAPTLAVGMAYILHGALGGMMDVAFWYHFAILFEALFILTAVDAGTRAARFMLQDLLGVVSPGLKRTDSLPANLLATALCVLAWGYFLHQGVVDPLGGINTLWPLFGIANQMLAGMALMLCAVVLFKMKRQRYAWVALVPTAWLLICTLTAGWQKAFSPDAKVGFLAIANKFQAMIDSGNIPSQYTESQLAQLVFNNRLDAGLTIFFMVVVVVLALFSIKTALAALKDPKPTAKETPYEPMPENVEEIVAQAKGAH

SEQ ID NO: 1669 - protein, 536 aa, Escherichia coli
MSIPFTRWPEEFARRYREKGYWQDLPLTDILTRHAASDSIAVIDGERQLSYRELNQAADNLACSLRRQGIKPGETALVQLGNVAELYITFFALLKLGVAPVLALFSHQRSELNAYASQIEPALLIADRQHALFSGDDFLNTFVTEHSSIRVVQLLNDSGEHNLQDAINHPAEDFTATPSPADEVAYFQLSGGTTGTPKLIPRTHNDYYYSVRRSVEICQFTQQTRYLCAIPAAHNYAMSSPGSLGVFLAGGTVVLAADPSATLCFPLIEKHQVNVTALVPPAVSLWLQALIEGESRAQLASLKLLQVGGARLSATLAARIPAEIGCQLQQVFGMAEGLVNYTRLDDSAEKIIHTQGYPMCPDDEVWVADAEGNPLPQGEVGRLMTRGPYTFRGYYKSPQHNASAFDANGFYCSGDLISIDPEGYITVQGREKDQINRGGEKIAAEEIENLLLRHPAVIYAALVSMEDELMGEKSCAYLVVKEPLRAVQVRRFLREQGIAEFKLPDRVECVDSLPLTAVGKVDKKQLRQWLASRASA

SEQ ID NO: 1670 - protein, 484 aa, Escherichia coli
MNNKGSGLTPAQALDKLDALYEQSVVALRNAIGNYITSGELPDENARKQGLFVYPSLTVTWDGSTTNPPKTRAFGRFTHAGSYTTTITRPTLFRSYLNEQLTLLYQDYGAHISVQPSQHEIPYPYVIDGSELTLDRSMSAGLTRYFPTTELAQIGDETADGIYHPTEFSPLSHFDARRVDFSLARLRHYTGTPVEHFQPFVLFTNYTRYVDEFVRWGCSQILDPDSPYIALSCAGGNWITAETEAPEEAISDLAWKKHQMPAWHLITADGQGITLVNIGVGPSNAKTICDHLAVLRPDVWLMIGHCGGLRESQAIGDYVLAHAYLRDDHVLDAVLPPDIPIPSIAEVQRALYDATKLVSGRPGEEVKQRLRTGTVVTTDDRNWELRYSASALRFNLSRAVAIDMESATIAAQGYRFRVPYGTLLCVSDKPLHGEIKLPGQANRFYEGAISEHLQIGIRAIDLLRAEGDRLHSRKLRTFNEPPFR

SEQ ID NO: 1671 - protein, 255 aa, Escherichia coli [sequence omitted]

SEQ ID NO: 1672 - protein, 284 aa, Escherichia coli
MYVVSTKQMLNNAQRGGYAVPAFNIHNLETMQVVVETAANLHAPVIIAGTPGTFTHAGTENLLALVSAMAKQYHHPLAIHLDHHTKFDDIAQKVRSGVRSVMIDASHLPFAQNISRVKEVVDFCHRFDVSVEAELGQLGGQEDDVQVNEADALYTNPAQAREFAEATGIDSLAVAIGTAHGMYASAPALDFSRLENIRQWVNLPLVLHGASGLSTKDIQQTIKLGICKINVATELKNAFSQALKNYLTEHPEATDPRDYLQSAKSAMRDVVSKVIADCGCEGRA

SEQ ID NO: 1673 - protein, 746 aa, Escherichia coli
MNKKIHSLALLVNLGIYGVAQAQEPTDTPVSHDDTIVVTAAEQNLQAPGVSTITADEIRKNPVARDVSKIIRTMPGVNLTGNSTSGQRGNNRQIDIRGMGPENTLILIDGKPVSSRNSVRQGWRGERDTRGDTSWVPPEMIERIEVLRGPAAARYGNGAAGGVVNIITKKGSGEWHGSWDAYFNAPEHKEEGATKRTNFSLTGPLGDEFSFRLYGNLDKTQADAWDINQGHQSARAGTYATTLPAGREGVINKDINGVVRWDFAPLQSLELEAGYSRQGNLYAGDTQNTNSDSYTRSKYGDETNRLYRQNYALTWNGGWDNGVTTSNWVQYEHTRNSRIPEGLAGGTEGKFNEKATQDFVDIDLDDVMLHSEVNLPIDFLVNQTLTLGTEWNQQRMKDLSSNTQALTGTNTGGAIDGVSTTDRSPYSKAEIFSLFAENNMELTDSTIVTPGLRFDHHSIVGNNWSPALNISQGLGDDFTLKMGIARAYKAPSLYQTNPNYILYSKGQGCYASAGGCYLQGNDDLKAETSINKEIGLEFKRDGWLAGVTWFRNDYRNKIEAGYVAVGQNAVGTDLYQWDNVPKAVVEGLEGSLNVPVSETVMWTNNITYMLKSENKTTGDRLSIIPEYTLNSTLSWQAREDLSMQTTFTWYGKQQPKKYNYKGQPAVGPETKEISPYSIVGLSATWDVTKNVSLTGGVDNLFDKRLWRAGNAQTTGDLAGANYIAGAGAYTYNEPGRTWYMSVNTHF

SEQ ID NO: 1674 - protein, 417 aa, Escherichia coli
MSGSNTAISRRRLLQGAGAMWLLSVSQVSLAAVSQVVAVRVWPASSYTRVTVESNRQLKYKQFALSNPERVVVDIEDVNLNSVLKGMAAQIRADDPFIKSARVGQFDPQTVRMVFELKQNVKPQLFALAPVAGFKERLVMDLYPANAQDMQDPLLALLEDYNKGDLEKQVPPAQSGPQPGKAGRDRPIVIMLDPGHGGEDSGAVGKYKTREKDVVLQIARRLRSLIEKEGNMKVYMTRNEDIFIPLQVRVAKAQKQRADLFVSIHADAFTSRQPSGSSVFALSTKGATSTAAKYLAQTQNASDLIGGVSKSGDRYVDHTMFDMVQSLTIADSLKFGKAVLNKLGKINKLHKNQVEQAGFAVLKAPDIPSILVETAFISNVEEERKLKTATFQQEVAESILAGIKAYFADGATLARRG

SEQ ID NO: 1675 - protein, 183 aa, Escherichia coli
MQDSILTTVVKDIDGEVTTLEKFAGNVLLIVNVASKCGLTPQYEQLENIQKAWVDRGFMVLGFPCNQFLEQEPGSDEEIKTYCTTTWGVTFPMFSKIEVNGEGRHPLYQKLIAAAPTAVAPEESGFYARMVSKGRAPLYPDDILWNFEKFLVGRDGKVIQRFSPDMTPEDPIVMESIKLALAK

SEQ ID NO: 1676 - protein, 366 aa, Escherichia coli
MSNAQEAVKTRHKETSLIFPVLALVVLFLWGSSQTLPVVIAINLLALIGILSSAFSVVRHADVLAHRLGEPYGSLILSLSVVILEVSLISALMATGDAAPTLMRDTLYSIIMIVTGGLVGFSLLLGGRKFATQYMNLFGIKQYLIALFPLAIIVLVFPMALPAANFSTGQALLVALISAAMYGVFLLIQTKTHQSLFVYEHEDDSDDDDPHHGKPSAHSSLWHAIWLIIHLIAVIAVTKMNASSLETLLDSMNAPVAFTGFLVALLILSPEGLGALKAVLNNQVQRAMNLFFGSVLATISLTVPVVTLIAFMTGNELQFALGAPEMVVMVASLVLCHISFSTGRTNVLNGAAHLALFAAYLMTIFA

SEQ ID NO: 1677 - protein, 878 aa, Escherichia coli
MSYLNLRLYQRNTQCLHIRKHRLAGFFVRLVVACAFAAQAPLSSADLYFNPRFLADDPQAVADLSRFENGQELPPGTYRVDIYLNNGYMATRDVTFNTGDSEQGIVPCLTRAQLASMGLNTASVAGMNLLADDACVPLTTMVQDATAHLDVGQQRLNLTIPQAFMSNRARGYIPPELWDPGINAGLLNYNFSGNSVQNRIGGNSHYAYLNLQSGLNIGAWRLRDNTTWSYNSSDRSSGSKNKWQHINTWLERDIIPLRSRLTLGDGYTQGDIFDGINFRGAQLASDDNMLPDSQRGFAPVIHGIARGTAQVTIKQNGYDIYNSTVPPGPFTINDIYAAGNSGDLQVTIKEADGSTQIFTVPYSSVPLLQREGHTRYSITAGEYRSGNAQQEKTRFFQSTLLHGLPAGWTIYGGTQLADRYRAFNFGIGKNMGALGALSVDMTQANSTLPDDSQHDGQSVRFLYNKSLNESGTNIQLVGYRYSTSGYFNFADTTYSRMNGYNIETQDGVIQVKPKFTDYYNLAYNKRGKLQLTVTQQLGRTSTLYLSGSHQTYWGTSNVDEQFQAGLNTAFEDINWTLSYSLTKNAWQKGRDQMLALNVNIPFSHWLRSDSKSQWRHASASYSMSHDLNGRMTNLAGVYGTLLEDNNLSYSVQTGYAGGGDGNSGSTGYATLNYRGGYGNANIGYSHSDDIKQLYYGVSGGVLAHANGVTLGQPLNDTVVLVKAPGAKDAKVENQTGVRTDWRGYAVLPYATEYRENRVALDTNTLADNVDLDNAVANVVPTRGAIVRAEFKARVGIKLLMTLTHNNKPLPFGAMVTSESSQSSGIVADNGQVYLSGMPLAGKVQVKWGEEENAHCVANYQLPPESQQQLLTQLSAECR

SEQ ID NO: 1678 - protein, 241 aa, Escherichia coli
MITLKNVSKWYGHFQVLTDCSTEVKKGEVVVVCGPSGSGKSTLIKTVNGLEPVQQGEITVDGIVVNDKKTDLAKLRSRVGMVFQHFELFPHLSIIENLTLAQVKVLKRDKAPAREKALKLLERVGLSAHANKFPAQLSGGQQQRVAIARALCMDPIAMLFDEPTSALDPEMINEVLDVMVELANEGMTMMVVTHEMGFARKVANRVIFMDEGKIVEDSPKDAFFDDPKSDRAKDFLAKILH

SEQ ID NO: 1679 - protein, 396 aa, Escherichia coli
MTTRQHSSFAIVFILGLLAMLMPLSIDMYLPALPVISAQFGVPAGSTQMTLSTYILGFALGQLIYGPMADSFGRKPVVLGGTLVFAAAAVACALANTIDQLIVMRFFHGLAAAAASVVINALMRDIYPKEEFSRMMSFVMLVTTIAPLMAPIVGGWVLVWLSWHYIFWILALAAILASAMIFFLIKETLPPERRQPFHIRTTIGNFAALFRHKRVLSYMLASGFSFAGMFSFLSAGPFVYIEINHVAPENFGYYFALNIVFLFVMTIFNSRFVRRIGALNMFRSGLWIQFIMAAWMVISALLGLGFWSLVVGVAAFVGCVSMVSSNAMAVILDEFPHMAGTASSLAGTFRFGIGAIVGALLSLATFNSAWPMIWSIAFCATSSILFCLYASRPKKR

SEQ ID NO: 1680 - protein, 109 aa, Escherichia coli
MSHSTDHSGASHGSVKTYMTGFILSIILTVIPFWMVMTGAASPAVILGTILAMAVVQVLVHLVCFLHMNTKSDEGWNMTAFVFTVLIIAILVVGSIWIMWNLNYNMMMH

SEQ ID NO: 1681 - protein, 310 aa, Escherichia coli
MKTLIRKFSRTAITVVLVILAFIAIFNAWVYYTESPWTRDARFSADVVAIAPDVSGLITQVNVHDNQLVKKGQILFTIDQPRYQKALEEAQADVAYYQVLAQEKRQEAGRRNRLGVQAMSREEIDQANNVLQTVLHQLAKAQATRDLAKLDLERTVIRAPADGWVTNLNVYTGEFITRGSTAVALVKQNSFYVLAYMEETKLEGVRPGYRAEITPLGSNKVLKGTVDSVAAGVTNASSTRDDKGMATIDSNLEWVRLAQRVPVRIRLDNQQENIWPAGTTATVVVTGKQDRDESQDSFFRKMAHRLREFG

SEQ ID NO: 1682 - protein, 231 aa, Escherichia coli
MFRKLAAECFGTFWLVFGGCGSAVLAAGFPELGIGFAGVALAFGLTVLTMAFAVGHISGGHFNPAVTIGLWAGGRFPAKEVVGYVIAQVVGGIVAAALLYLIASGKTGFDAAASGFASNGYGEHSPGGYSMLSALVVELVLSAGFLLVIHGATDKFAPAGFAPIAIGLALTLIHLISIPVTNTSVNPARSTAVAIFQGGWALEQLWFFWVVPIVGGIIGGLIYRTLLEKRD

SEQ ID NO: 1683 - protein, 266 aa, Escherichia coli
MKLAHLGRQALMGVMAVALVAGMSVKSFADEGLLNKVKERGTLLVGLEGTYPPFSFQGDDGKLTGFEVEFAQQLAKHLGVEASLKPTKWDGMLASLDSKRIDVVINQVTISDERKKKYDFSTPYTISGIQALVKKGNEGTIKTADDLKGKKVGVGLGTNYEEWLRQNVQGVDVRTYDDDPTKYQDLRVGRIDAILVDRLAALDLVKKTNDTLAVTGEAFSRQESGVALRKGNEDLLKAVNDAIAEMQKDGTLQALSEKWFGADVTK

SEQ ID NO: 1684 - protein, 238 aa, Escherichia coli
MNEFFPLASAAGMTVGLAVCALIVGLALAMFFAVWESAKWRPVAWAGSALVTILRGLPEILVVLFIYFGSSQLLLTLSDGFTINLGFVQIPVQMDIENFDVSPFLCGVIALSLLYAAYASQTLRGALKAVPVGQWESGQALGLSKSAIFFRLVMPQMWRHALPGLGNQWLVLLKDTALVSLISVNDLMLQTKSIATRTQEPFTWYIVAAAIYLVITLLSQYILKRIDLRATRFERRPS

SEQ ID NO: 1685 - protein, 379 aa, Escherichia coli
MKKNIFKFSVLTLAVLSLTACTLVPGQNLSTSNKDVIELPDNQYDLDKMVNIYPVTPGLIDQLRAKPIMSQANPELEQQIANYEYRIGIGDVLMVTVWDHPELTTPAGQYRSASDTGNWVNADGAIFYPYIGRLKVAGKTLTQVRNEITARLDSVIESPQVDVSVAAFRSQKAYVTGEVSKSGQQPITNIPLTIMDAINAAGGLTADADWRNVVLTQNGVKTKVNLYALMQRGDLRQNKLLHPGDILFIPRNDDLKVFVMGEVGKQSTLKMDRSGMTLAEALGNAEGMNQDVADATGIFVIRATQNKQNGKIANIYQLNAKDASAMILGTEFQLEPYDIVYVTTAPLARWNRVISLLVPTISGVHDLTETSRWIQTWPN

SEQ ID NO: 1686 - protein, 316 aa, Escherichia coli
MLSAFQLENNRLTRLEVEESQPLVNAVWIDLVEPDDDERLRVQSELGQSLATRPELEDIEASARFFEDDDGLHIHSFFFFEDAEDHAGNSTVAFTIRDGRLFTLRERELPAFRLYRMRARSQSMVDGNAYELLLDLFETKIEQLADEIENIYSDLEQLSRVIMEGHQGDEYDEALSTLAELEDIGWKVRLCLMDTQRALNFLVRKARLPGGQLEQAREILRDIESLLPHNESLFQKVNFLMQAAMGFINIEQNRIIKIFSVVSVVFLPPTLVASSYGMNFEFMPELKWSFGYPGAIIFMILAGLAPYLYFKRKNWL

SEQ ID NO: 1687 - protein, 348 aa, Escherichia coli
MTQKNFVELRNVTKRFGSNTVIDNINLTIPQGQMVTLLGPSGCGKTTILRLVAGLEKPSEGQIFIDGEDVTHRSIQQRDICMVFQSYALFPHMSLGENVGYGLKMLGVPRAELKARVKEALAMVDLEGFEDRFVDQISGGQQQRVALARALILKPKVLLFDEPLSNLDANLRRSMRDKIRELQKQFDITSLYVTHDQSEAFAVSDTVLVMNKGHIMQIGSPQDLYRQPASRFMASFMGDANLFPATFSDGYVDIYGYHLPRPLHFGTQGEGMVGVRPEAITLSDRGEESQRCVIRHVAYMGPQYEVTVEWHGQEILLQVNATRLQPDVGEQYYLEIHPYGMFVLADAA

SEQ ID NO: 1688 - protein, 416 aa, Escherichia coli
MNKQSWLLNLSLLKTHPAFRAVFLARFISIVSLGLLGVAVPVQIQMMTHSTWQVGLSVTLTGGAMFVGLMVGGVLADRYERKKVILLARGTCGIGFIGLCLNALLPEPSLLAIYLLGLWDGFFASLGVTALLAATPALVGRENLMQAGAITMLTVRLGSVISPMIGGLLLATGGVAWNYGLAAAGTFITLLPLLSLPALPPPPQPREHPLKSLLAGFRFLLASPLVGGIALLGGLLTMASAVRVLYPALADNWQMSAAQIGFLYAAIPLGAAIGALTSGKLAHSARPGLLMLLSTLGSFLAIGLFGLMPMWILGVVCLALFGWLSAVSSLLQYTMLQTQTPEAMLGRINGLWTAQNVTGDAIGAALLGGLGAMMTPVASASASGFGLLIIGVLLLLVLVELRHFRQTPPQVTASDS

SEQ ID NO: 1689 - protein, 406 aa, Escherichia coli
MAMSEQPQPVAGAAASTTKARTSFGILGAISLSHLLNDMIQSLILAIYPLLQSEFSLTFMQIGMITLTFQLASSLLQPVVGYWTDKYPMPWSLPIGMCFTLSGLVLLALAGSFGAVLLAAALVGTGSSVFHPESSRVARMASGGRHGLAQSIFQVGGNFGSSLGPLLAAVIIAPYGKGNVAWFVLAALLAIVVLAQISRWYSAQHRMNKGKPKATIINPLPRNKVVLAVSILLILIFSKYFYMASISSYYTFYLMQKFGLSIQNAQLHLFAFLFAVAAGTVIGGPVGDKIGRKYVIWGSILGVAPFTLILPYASLHWTGVLTVIIGFILASAFSAILVYAQELLPGRIGMVSGLFFGFAFGMGGLGAAVLGLIADHTSIELVYKICAFLPLLGMLTIFLPDNRHKD

SEQ ID NO: 1690 - protein, 378 aa, Escherichia coli
MFDYETLRFIWWLLIGVILVVFMISDGFDMGIGCLLPLVARNDDERRIVINSVGAHWEGNQVWLILAGGALFAAWPRVYAAAFSGFYVAMILVLCSLFFRPLAFDYRGKIADARWRKMWDAGLVIGSLVPPVVFGIAFGNLLLGVPFAFTPQLRVEYLGSFWQLLTPFPLLCGLLSLGMVILQGGVWLQLKTVGVIHLRSQLATKRAALLVMLCFLLAGYWLWVGIDGFVLLAQDANGPSNPLMKLVAVLPGAWMNNFVESPVLWIFPLLGFFCPLLTVMAIYRGRPGWGFLMASLMQFGVIFTAGITLFPFVMPSSVSPISSLTLWDSTSSQLTLSIMLVIVLIFLPIVLLYTLWSYYKMWGRMTTETLRRNENELY

SEQ ID NO: 1691 - protein, 841 aa, Escherichia coli
MPLRRFSPGLKAQFAFGMVFLFVQPDASAADISAQQIGGVIIPQAFSQALQDGMSVPLYIHLAGSQGRQDDQRIGSAFIWLDDGQLRIRKIQLEESEDNASVSEQTRQQLMALANAPFNEALTIPLTDNAQLDLSLRQLLLQLVVKREALGTVLRSRSEDIGQSSVNTLSSNLSYNLGVYNNQLRNGGSNTSSYLSLNNVTALREHHVVLDGSLYGIGSGQQDSELYKAMYERDFAGHRFAGGMLDTWNLQSLGPMTAISAGKIYGLSWGNQASSTIFDSSQSATPVIAFLPAAGEVHLTRDGRLLSVQNFTMGNHEVDTRGLPYGIYDVEVEVIVNGRVISKRTQRVNKLFSRGRGVGAPLAWQVWGGSFHMDRWSENGKKTRPAKESWLAGASTSGSLSTLSWAATGYGYDNQAVGETRLTLPLGGAINVNLQNMLASDSSWSSIGSISATLPGGFSSLWVNQEKTRIGNQLRRSDADNRAIGGTLNLNSLWSKLGTFSISYNDDRRYNSHYYTADYYQNVYSGTFGSLGLRAGIQRYNNGDSNANTGKYIALDLSLPLGNWFSAGMTHQNGYTMANLSARKQFDEGTIRTVGANLSRAISGDTGDDKTLSGGAYAQFDARYASGTLNVNSAADGYVNTNLTANGSVGWQGKNIAASGRTDGNAGVIFNTGLEDDGQISAKINGRIFPLNGKRNYLPLSPYGRYEVELQNSKNSLDSYDIVSGRKSRLTLYPGNVAVIEPEVKQMVTVSGRIRAEDGTLLANARINNHIGRTRTDENGEFVMDVDKKYPTIDFRYSGNKTCEVALELNQARGAVWVGDVVCSGLSSWAAVTQTGEENES

SEQ ID NO: 1692 - protein, 444 aa, Escherichia coli
MILDTVDEKKKGVHTRYLILLIIFIVTAVNYADRATLSIAGTEVAKELQLSAVSMGYIFSAFGWAYLLMQIPGGWLLDKFGSKKVYTYSLFFWSLFTFLQGFVDMFPLAWAGISMFFMRFMLGFSEAPSFPANARIVAAWFPTKERGTASAIFNSAQYFSLALFSPLLGWLTFAWGWEHVFTVMGVIGFVLTALWIKLIHNPTDHPRMSAEELKFISENGAVVDMDHKKPGSAAASGPKLHYIKQLLSNRMMLGVFFGQYFINTITWFFLTWFPIYLVQEKGMSILKVGLVASIPALCGFAGGVLGGVFSDYLIKRGLSLTLARKLPIVLGMLLASTIILCNYTNNTTLVVMLMALAFFGKGFGALGWPVISDTAPKEIVGLCGGVFNVFGNVASIVTPLVIGYLVSELHSFNAALVFVGCSALMAMVCYLFVVGDIKRMELQK

SEQ ID NO: 1693 - protein, 573 aa, Escherichia coli
MRALLPYLALYKRHKWMLSLGIVLAIVTLLASIGLLTLSGWFLSASAVAGVAGLYSFNYMLPAAGVRGAAITRTAGRYFERLVSHDATFRVLQHLRIYTFSKLLPLSPAGLARYRQGELLNRVVADVDTLDHLYLRVISPLVGAFVVIMVVTIGLSFLDFTLAFTLGGIMLLTLFLMPPLFYRAGKSTGQNLTHLRGQYRQQLTAWLQGQAELTIFGASDRYRTQLENTEIQWLEAQRRQSELTALSQAIMLLIGALAVILMLWMASGGVGGNAQPGALIALFVFCALAAFEALAPVTGAFQHLGQVIASAVRISDLTDQKPEVTFPDTQTRVADRVSLTLRDVQFTYPEQSQQALKGISLQVNAGEHIAILGRTGCGKSTLLQQLTRAWDPQQGEILLNDSPIASLNEAALRQTISVVPQRVHLFSATLRDNLLLASPGSSDEALSEILRRVGLEKLLEDAGLNSWLGEGGRQLSGGELRRLAIARALLHDAPLVLLDEPTEGLDATTESQILELLAEMMREKTVLMVTHRLRGLSRFQQIIVMDNGQIIEQGTHAELLARQGRYYQFKQGL

SEQ ID NO: 1694 - protein, 400 aa, Escherichia coli
MTALKVGSESWWQSKHGPEWQRLNDEMFEVTFWWRDPQGSEEYSTIKRVWVYITGVTDHHQNSQPQSMQRIAGTNVWQWTTQLNANWRGSYCFIPTERDDIFSVPSPDRLELREGWRKLLPQAIADPLNLQSWKGGRGHAVSALEMPQAPLQPGWDCPQAPEIPAKEIIWKSERLKKSRRVWIFTTGDATAEERPLAVLLDGEFWAQSMPVWPVLTSLTHRQQLPPAVYVLIDAIDTTHRAHELPCNADFWLAVQQELLPLVKAIAPFSDRADRTVVAGQSFGGLSALYAGLHWPERFGCVLSQSGSYWWPHRGGQQEGVLLEKLKAGEVSAEGLRIVLEAGIREPMIMRANQALYAQLHPIKESIFWRQVDGGHDALCWRGGLMQGLIDLWQPLFHDRS

SEQ ID NO: 1695 - protein, 401 aa, Escherichia coli
MFHLDTLATLVAATLTLLLGRKLVHSVSFLKKYTIPEPVAGGLLVALALLVLKKSMGWEVNFDMSLRDPLMLAFFATIGLNANIASLRAGGRVVGIFLIVVVGLLVMQNAIGIGMASLLGLDPLMGLLAGSITLSGGHGTGAAWSKLFIERYGFTNATEVAMACATFGLVLGGLIGGPVARYLVKHSTTPNGIPDDQEVPTAFEKPDVGRMITSLVLIETIALIAICLTVGKIVAQLLAGTAFELPTFVCVLFVGVILSNGLSIMGFYRVFERAVSVLGNVSLSLFLAMALMGLKLWELASLALPMLAILVVQTIFMALYAIFVTWRMMGKNYDAAVLAAGHCGFGLGATPTAIANMQAITERFGPSHMAFLVVPMVGAFFIDIVNALVIKLYLMLPIFAG

SEQ ID NO: 1696 - protein, 292 aa, Escherichia coli
MSDDNSHSSDTISNKKGFFSLLLSQLFHGEPKNRDELLALIRDSGQNDLIDEDTRDMLEGVMDIADQRVRDIMIPRSQMITLKRNQTLDECLDVIIESAHSRFPVISEDKDHIEGILMAKDLLPFMRSDAEAFSMDKVLRQAVVVPESKRVDRMLKEFRSQRYHMAIVIDEFGGVSGLVTIEDILELIVGEIEDEYDEEDDIDFRQLSRHTWTVRALASIEDFNEAFGTHFSDEEVDTIGGLVMQAFGHLPARGETIDIDGYQFKVAMADSRRIIQVHVKIPDDSPQPKLDE

SEQ ID NO: 1697 - protein, 472 aa, Escherichia coli
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 1698 - protein, 774 aa, Escherichia coli
MTPLRVFRKTTPLVNTIRLSLLPLAGLSFSAFAAQVNIAPGSLDKALNQYAAHSGFTLSVDASLTRGKQSNGLHGDYDVESGLQQLLDGSGLQVKPLGNNSWTLEPAPAPKEDALTVVGDWLGDARENDVFEHAGARDVIRREDFAKTGATTMREVLNRIPGVSAPENNGTGSHDLAMNFGIRGLNPRLASRSTVLMDGIPVPFAPYGQPQLSLAPVSLGNMDAIDVVRGGGAVRYGPQSVGGVVNFVTRAIPQDFGIEAGVEGQLSPTSSQNNPKETHNLMVGGTADNGFGTALLYSGTRGSDWREHSATRIDDLMLKSKYAPDEVHTFNSLLQYYDGEADMPGGLSRADYDADRWQSTRPYDRFWGRRKLASLGYQFQPDSQHKFNIQGFYTQTLRSGYLEQGKRITLSPRNYWVRGIEPRYSQIFMIGPSAHEVGVGYRYLNESTHEMRYYTATSSGQLPSGSSPYDRDTRSGTEAHAWYLDDKIDIGNWTITPGMRFEHIESYQNNAITGTHEEVSYNAPLPALNVLYHLTDSWNLYANTEGSFGTVQYSQIGKAVQSGNVEPEKARTWELGTRYDDGALTAEMGLFLINFNNQYDSNQTNDTVTARGKTRHTGLETQARYDLGTLTPTLDNVSIYASYAYVNAEIREKGDTYGNLVPFSPKHKGTLGVDYKPGNWTFNLNSDFQSSQFADNANTVKESADGSTGRIPGFMLWGARVAYDFGPQMADLNLAFGVKNIFDQDYFIRSYDDNNKGIYAGQPRTLYMQGSLKF

SEQ ID NO: 1699 - protein, 329 aa, Escherichia coli
MHKFTKALAAIGLAAVMSQSAMAENLKLGFLVKQPEEPWFQTEWKFADKAGKDLGFEVIKIAVPDGEKTLNAIDSLAASGAKGFVICTPDPKLGSAIVAKARGYDMKVIAVDDQFVNAKGKPMDTVPLVMMAATKIGERQGQELYKEMQKRGWDVKESAVMAITANELDTARRRTTGSMDALKAAGFPEKQIYQVPTKSNDIPGAFDAANSMLVQHPEVKHWLIVGMNDSTVLGGVRATEGQGFKAADIIGIGINGVDAVSELSKAQATGFYGSLLPSPDVHGYKSSEMLYNWVAKDVEPPKFTEVTDVVLITRDNFKEELEKKGLGGK

SEQ ID NO: 1700 - protein, 591 aa, Escherichia coli
MKKISLPKIGIRPVIDGRRMGVRESLEEQTMNMAKATAALLTEKLRHACGAAVECVISDTCIAGMAEAAACEEKFSSQNVGLTITVTPCWCYGSETIDMDPTRPKAIWGFNGTERPGAVYLAAALAAHSQKGIPAFSIYGHDVQDADDTSIPADVEEKLLRFARAGLAVASMKGKSYLSLGGVSMGIAGSIVDHNFFESWLGMKVQAVDMTELRRRIDQKIYDEAELEMALAWADKNFRYGEDENNKQYQRNAEQSRAVLRESLLMAMCIRDMMQGNSKLADIGRVEESLGYNAIAAGFQGQRHWTDQYPNGDTAEAILNSSFDWNGVREPFVVATENDSLNGVAMLMGHQLTGTAQVFADVRTYWSPEAIERVTGHKLDGLAEHGIIHLINSGSAALDGSCKQRDSEGNPTMKPHWEISQQEADACLAATEWCPAIHEYFRGGGYSSRFLTEGGVPFTMTRVNIIKGLGPVLQIAEGWSVELPKDVHDILNKRTNSTWPTTWFAPRLTGKGPFTDVYSVMANWGANHGVLTIGHVGADFITLASMLRIPVCMHNVEETKVYRPSAWAAHGMDIEGQDYRACQNYGPLYKR

SEQ ID NO: 1701 - protein, 205 aa, Escherichia coli
MTTQYGFFIDSSRCTGCKTCELACKDYKDLTPEVSFRRIYEYAGGDWQEDNGVWHQNVFAYYLSISCNHCEDPACTKVCPSGAMHKREDGFVVVDEDVCIGCRYCHMACPYGAPQYNETKGHMTKCDGCYDRVAEGKKPICVESCPLRALDFGPIDELRKKHGDLAAVAPLPRAHFTKPNIVIKPNANSRPTGDTTGYLANPKEV

SEQ ID NO: 1702 - protein, 246 aa, Escherichia coli
MSIDWNWGIFLQQAPFGNTTYLGWIWSGFQVTIALSICAWIIAFLVGSFFGILRTVPNRFLSGLGTLYVELFRNVPLIVQFFTWYLVIPELLPEKIGMWFKAELDPNIQFFLSSMLCLGLFTAARVCEQVRAAIQSLPRGQKNAALAMGLTLPQAYRYVLLPNAYRVIVPPMTSEMMNLVKNSAIASTIGLVDMAAQAGKLLDYSAHAWESFTAITLAYVLINAFIMLVMTLVERKVRLPGNMGGK

SEQ ID NO: 1703 - protein, 115 aa, Escherichia coli
MVSNASALGRNGVHDFILVRATAIVLTLYIIYMVGFFATSGELTYEVWIGFFASAFTKVFTLLALFSILIHAWIGMWQVLTDYVKPLALRLMLQLVIVVALVVYVIYGFVVVWGV

SEQ ID NO: 1704 - protein, 376 aa, Thermoprotei archaeon
MRLSRIGASKTAAIVIVVVVIVAAIAGLAAYMSTVPPAPTTTTPTTTATTPTETAPTATTAAPGKITLALFISNLGNPYFVMMKDGAVKAIEELKSKGVNIELKVYDAKDDPSLQVNQIETAVSEGVDAILVNPVHKEAIQPALEKAKDRGIPVVTTDRDVANPELRLVFIGTDNVKGGELAAKALIKALEESGKSKPWKIVILHGIPGTTAAEDRKKGFHNVLDSYIEKGDIEVVAEEIANFRRDEALSKMESLLAKTKDVDAVICANDEMALGAIQAIEGAGLTPGKDIIVVGYDAIPDAVKAVKEGKMYATMAQSPFLQGYWAVYAAYYHIVKDWKPSADFIPTPLVVVTSENADTFQEETAKPQPLPGAPSE

SEQ ID NO: 1705 - protein, 345 aa, Thermogladius calderae
MGKALSKTITYVIIAIVVIAVAGGLAYWYYSSQKPSGIKVGLFISNLGNPYFALLRDGAQAAVNELKNKGVSIEMVVYDAKDDPSLQSNQIETAVGQKFSALVVNPTDIQAIQPSLSKAKSAGIPVVTTDRDVADKTLRFVFIGTDNVKGAEQAANALIQALTESGKPTPWKVVILNGIPGTTAAIDRNKGFHNVLDPLVSQGKVVIVAEEVANFRRDEALSKMESILAAKKVDAVIAANDEMALGAIQAIKGAGLTPGKDIIVVGYDAIPDAVAAVKAGEMYATIAQSPFLQGYWGILAAYYRVTQNWNPPADWIPTPTVVVTKANADTFQQEVSTPKPLPGAP

SEQ ID NO: 1706 - protein, 337 aa, Thermoprotei archaeon
MILVIIVVIAVVAAYYFFVAQQAGPGKISLALLISNLGNPYFVALRDGAQAAVNELKDKGVDIEMEVYDAKDDPSLQSSQIETAVGKKVSAILINPVHAEAIQPALRKAIEAGIPVITTDRDVADTSLRLVFIGTDNVAGAEAAAQALLQALEASGKPTPWKIVILNGIPGTTAAEDRKKGFHNILDPLVGQGKIEIVAEEVANFRRDEALSKMESILAAHTVDAVIAANDEMALGAIQAIEGAGLKPGDDIIVVGYDAIPDAVQAVKAEKMYATIAQSPFLQGYWAVYAAYYHIVNDWKPSEDWIPTPTVVVTKDNADTFQAEVSSPKPLPGAPTS

SEQ ID NO: 1707 - protein, 350 aa, Archaeoglobales archaeon
MKYRKAVTKTVAIGIIIIVIAAAIGVAAYFLLAPPKAPEFDVALFISNLGNPYFVALKNGSDAAVSELEQKGITVKLTVYDAKDDASLQTSQIETAVGQKVDAIVVNPVHKEAIQPALEKALEAGIPVVTTDRDVANKSLRICFTGTDNVEGGELAAKALIEALRASGKPTPWKVVILNGIPGTTAAEERKTGFHNILDDFVDNGTVEIVAEEVANFRRDEGQSDMESILAAHPDVDAVICANDEMALGAILAIEGADLTPGEDIIVVGYDAIPDAVQAIKDGKMYATIAQSPFLQGYWGVLIAYYYVFKNWQPEEDFIPTPLVVVTAENVDTFSEEVASPKPLPGAPSE

SEQ ID NO: 1708 - protein, 350 aa, Korarchaeota archaeon; identical to SEQ ID NO: 1707

SEQ ID NO: 1709 - protein, 548 aa, Euryarchaeota archaeon SM23-78
MYRKVTRTGPATLTIALPAKWVKEHNLKPGQYVEVDESEADLIISPGIEKTPENIIIPYNEVLIENMLEKLFLEAEATITIHSEEKIPETITKIVERFPGMQITEMQPNKVIISRTLKPALSNPDALLRRSYIVIKEALTHNPPQFSSNLNETFFLLQLHQKRPKEIFILKELYSTILKLKKPVHDNTYALLRLVFNTVYEQKYNFSSTDTKHLAEIFGRTEDLFKNYYKKSKSPLQISEVHYCIHLLSQLHKEILYKQSIDVLTKATKLTSKRFRVGVCLKNQSNPFWAIDVKESIRQTAQGYKDMELIFKSPLKDFDINEQEEILKEFISEGMDGIMLAPIQPKRLKKIVDKINKLNIPLLILDTDIELEENKYTFIGFDNYKGGYLTGEYLKKHLKKGSNVLILKGHLEGNFTQRVPGFIDAMGKEYKTKVIVGHFQESTAYEKTLEYMKKNKVDAIFSTSDNMALGAIKAMEELNKKIPICGFDMTEGGLAALKKGKLLSEVNTKPREQGALGAHTMYNLLTKKTVAERIEYDIEFITKKQLTR

SEQ ID NO: 1710 - protein, 352 aa, Thermoprotei archaeon
MRTLGIAKKTLIGIVVAIIIIAVIAGVVASLYLAPAPGKKKLTFALLVSNLGNPYFVMLKDGAEAAVKELKAKGIEVELIVYDAKDDPDLQVRQIEEAIAKKVDALLINPVHKEAILPAVRDAVKAGIIVITTDRDIADKSLRVFFTGTDNVYGAELAVKALIEALEKSGKPKPWKIVILHGIPGTTAAEDRKKGFHNVLDPLVKKGDVKIVAEEIAYFRRDKGLEVMESILARTKEIDAVICANDEMALGAIQAIEGAGLVPGKDIIVVGYDAIPDAVEAVKAGKMYATIAQSPFLQGYWAVMGAYYIVVKGWKPPKDFIPTPVVVVTKANVGTFSEEVAKPKPLPGAPSE

SEQ ID NO: 1711 - protein, 346 aa, Thermoprotei archaeon
MPAISAKTLAIFIVVLIAVAGIAAFVGYQYGLSVGGGAAAKKRYKIGLVLKTLTNPYFIEMQKEFLRLSEKLGFEARVLSTATEQEVEKQVSMVEDLIAWGADAILITPDDSAGIVPAFKACREHGVICIAIDTPVEGDSPDNVVLADFFIGPDFVDAGEKVVDYVAKLLSPDDPSKAEGKIAIFLGVPGAGSTILKLKGIRKGLSKYPGLEVVFNQTGMYERARGASLAEDLLSAHPDVVVIISQNDLMALGALERLKALKRMDIIVTGMDAIPEACMSLLRGELKATINQRGADQVREAIYAAYKLLAGVELDKKWVDLPAELITKENVVMRIEKLKELGMWSS

SEQ ID NO: 1712 - protein, 351 aa, Woesearchaeota archaeon
MKQIFFICVLITFILVSGCVQQTPATTEESEEKMIVIGLSLSDMRVERWQTDRDFFIERAEELGASVIAVSADLSADVQESQAENLILQGIDVLVIVANDGEKAAAIVEKANEAGIKVIAYDRLIKNSDLDYYISFDNVKVGEYEAKGVLDVVSKGDFVYLGGSPTDNNAFLVKEGTFNLLQPKIDSGDITLVLDVFNDGWKSEEAYRQLKAYLSENKKVDAVVCANDGTALGAIQALEEFGLAGKVPVSGQDASLGACQMIAEGKQTVSVYKPIKTIAYKAAEMAVAIAKGETIETKQIVNNGKVDVPSYLLDVEMVTKDTLMNTVIKDGFQSYDDIYQNIPENERPAKD

SEQ ID NO: 1713 - protein, 385 aa, Natrarchaeobius chitinivorans
MCGMYLVVCMVVGPSDNDHKYRRRKLLTLGSAVALGGLAGCVGDDDEDSDGSPVNGDESSGNGGGSDNGDDDTMLIGFANKTLGVPFFARQEDGFHQAVETDLADHPSHLEASEIEGAGIEVPSLDGSTFNAEMSESSQIDQLETFLSRDPDAVIINPVSPTGANPALEEYREEDIPVINIDTEITEFEPDTYIASRNIELGRRAGELLLEFLDDAYDKSSYNVVELQGAAGDVGTRERHSGFREALEDSSVDVIGDEHADWAAQQALDAMEDMITRHGEDIDGVYAHNDFMAEGAYQALEGSDMGPLPTTSIDGSELWVTKFDEYEYYGSIAQQPENMTRLGIEKALMVANDIDIQDYYPIPGIRVTSENAEDYLAEFFPDAEM

SEQ ID NO: 1714 - protein, 316 aa, Euryarchaeota archaeon
MFMKNLLKFFAVFAFVFSTFVGSANAHSNKVYTIGFAAANLQADFFNFIKESVEAETARLGHKSIVVDSGGDDAKQVSQIEDLITKQIDALVLIISGNTDGNAQIRKAKEAGIPVITVDRNTTNPPGDSFVASDSEVASYQMGMWVAEQTGGKGVVGVIQGQLGSTPEIARDTGFENAIAQFPDLNTVEKQASKMWSRDEGVSIAQDLLTRNPNITVLYGRCDALAQGAAQAAKAMGRDDLLIVGFDGDRAALEDLKKGNTLLAATMTQQTLTIGRTATRFAIDAIEGRYIPPEVLYGSTLTTQENVEQFMGDGHP

SEQ ID NO: 1715 - protein, 324 aa, Halobacteriales archaeon
MPTHTSRRSVLQGATAAGVVGLGGCLGLGSGGDDAENQTALSVPTLEFTFFARMQNAFDDAIDERDDLGGSFYDAGNSQEQQVSDLETPVSQGVDFIMVAPITAEGISPVVEQANEADIPIVTIDRNIAEGDAATYVASDNVELGRRSMELCRGFMSDLSDADEYNVVELQGTQGASVTNDRAEGASEAIDSADDLTLLDSQGADFSTEEAVSVMEDFITSHGDDIDGVYAHNDLMALGAHQAVSNADIGDVATTGIDGSEAWVEEIQEVDHYGTLAQLPEEMVRQSIDYGLQAADGEDLDDYYRIEGLEVTSENAGDYLDEYF

SEQ ID NO: 1716 - protein, 351 aa, Halopelagius inordinatus
MSQNVRRRRFIRTGVIAGTAMLAGCSGDGGDGDSETTAGGGSDGTETTDETDGTETTGGESTPTVALSVPSLEFTFFARMENAFEQAQSDGLISSESSFYDASNNQSNQVSAVETAISNEVDFLMISAITAEGVINAIQQANDADIPVVAIDRNISQGETVTYVASDNVQLGQRSTELCLSFMEANGDGDSYDVVQLEGTPGASVTNDRGEGFQNAVSENDSLNQLATQTGEFSTQNALSVMEDFITQYGDEIDGVFCQNDLMALGAHQALRNANMSVPVTGIDGTEAWVEQFSDNEYYGTLAQLPEEMVTTAIESGKAHLAGEDVEDTITIEGLEVTQDNASDYLSDYFG

SEQ ID NO: 1717 - protein, 352 aa, Euryarchaeota archaeon
MFASAAGITSAAVVGPLGINPALAGSHGGWSMAWSYRDRASAYWNAIVSGGEAYVESLGMASSDMVNLINEGSSEKSLADIKAFLAKNGGKGAIACDANDSPNARPVVEAVREAGGYISTIWNKTDDLHPWDIGDNYVAHLSWSGEKPSADAARLLFDEMGGKGGVVHIGGIPANIPAIERLDGLKAALKDYPDVELLDVQSADWDTTKAAEVMSSLLTRYGDEIKGVHCANDNMAYGVIEALKAEGITDMPITAFDGNPEAVDLVMKGDLLATVFTNPHWGGGIALALAHQAAIGAFKPSEESNAHREFYGPSILVTPKDAAEFKATYLDSTPKYDWNDRWGLSAGQIQYK

SEQ ID NO: 1718 - protein, 366 aa, Salinigranum rubrum
MSRDVHRRQFVRSSLVAGTALVAGCAGGGGDEGDGAATEGGDGGGTSTEGDGAMTESGDGTETASGDGTETSGGGSTPRVALSVPSLEFTFFARMENAFEQAKSEGLIASDSSFYDSGNSQSAQVSDVETAISNDVDFLMISAITAEGVINAIQQANDAGIPVVAIDRNVAQGETVTYVASDNVQLGRRSTELCLSFMQDNADADTYDVVQLEGTPGASVTNERGEGFQNAVSENDSLNRLASQTGEFSTQNALSVMEDFITQYGDEIDGVFCQNDLMALGAHQALQNADMSVPVTGIDGTQAWVELFSDNQYYGTIAQLPEEMVTTAIDRGKAHLAGEDVQDTIVIEGLEVTQDNASDYLSQYFG

SEQ ID NO: 1719 - protein, 369 aa, Methanomicrobiales archaeon
MSLLIWSLKSSFFLLPPQYIHMVLYRSLLLMSLCSVLILITPSVLAESDNTGIELTHLSNFSIGIIPSGNTSPFHQELLASANKSAWDRGWTTQILTPDTEENITFQKMAMETLIRDNASIICLNTLDPSALSSEISAADAVGIPIFLYNTLSPVKDMNITGYIGYNQYTGAAEMGSYAARLLADKKNEALETVQGRVFILRGLPGFHADERTAGFIAGLSQSPGIRIVGEEVAGWDRETARQIAIKALTADHGIDIFYGNSDEMAIGAALAAIEKGKEVNKDIFILGIDGNTPTLEMIRNGTVTATLGVYPDLMGTTIIDQIEAVEMGRRVARYLGTPVIVVDSANLDEYINHSTWTDPKESDLEKGH

SEQ ID NO: 1720 - protein, 345 aa, Haloarcula sinaiiensis
MSRDICRRTFIRSGALAGTALLAGCGGNGEDGSGGGDDGQADGDGGGQQSTSGNSAPSAALSVPSLEITFFARMENAFNEAKNQGTIASDSAFYDAGNSQSTQISDIETAISNEVDFIMVSAITAEGVINAIQEANEADIPVVAIDRNVAEGDTVSYIASDNVQLGQRSTELCLSFMQDQGDQDSYNVVQLEGTPGASVTNERGEGFQNAVSNNDSLNQLATQTGEFSTQNALSVMEDFITQYGDEIDGVFCQNDLMALGAHQALQNAGMSVPVTGIDGTEAWVQRFSDNEYYGTLAQLPEDMVNTSIERAQAHINGKDVEDSVVIEGLEVTQKNASDYLSQYFG

SEQ ID NO: 1721 - protein, 350 aa, Euryarchaeota archaeon
MKRNRFLSVVVSVLTLSLISCGDKNSSAGSGELGNGETDTAFTGSVFKGAGEFIPCEHYFFADAEKDPNRESFAGASSDEATKPEESKGTVGMTCMNLNNPFFQLIAQEMEKAASAAGYTLKAMDGKGDAALQNTQIDEFITQKCDAIFLNPADSKATGSGVRAAHDAGIPVFTFDIQMEDPEVQKLVTYHVGSDNYQGGRLAGESMMKATGGIGKIGIINLPEANSCKKRVDGFKDYLMENNSKLEIVTELNGKGDRVKGAEVAADMLAAHGDLVGIFGINDPCALGAWASVKEAGKLEQITIIGFDGSPDGKIGVFEKKLYDTPMQFPGQMATKTVEAFLRYVAGDEL

SEQ ID NO: 1722 - protein, 313 aa, Thermococci archaeon
MRRHFIFAVGILMLVLIGVVFAEGFDIAVLLPGTVEFFSVERRGMDKAAEEFGLNLIYADAEWDAGKQLAQVENFIARNVDLILLCAADNLALRTAVTRCNEAGIPIIAFTNTIGTDPYGRYPGIVSYVGRSDLEAGIVLGKIAESIFEDESETVDIVLIEGNPGTAPQRMREEGFMQVADKHPNWNIVDKRPIDGWTKEGALAFMEAFLQSGRHADLVACQWWSGAIAAAMALKEKGIDDVYVIGLEFAKEIIPYIESGEVYATTYFSVVEEGYKAVETAYKYLSGEEVPEYVLIEQTIVTKDNLKNFEPEM

SEQ ID NO: 1723 - protein, 357 aa, Halobacteriales archaeon
MRDVTTRRDLLRSGAIAGTALLAGCGGDGDGDGGDGGNGGADGGDGGDGGDGADGDTPTETATPMSEGPMTTALSVPSLEFTFFARMQNAFDAAIEEGTISQESSFSGANNNSSQQVSDLETAITNEVDFIMVSAIREDAVVSTVEDAVDQGIPVVAIDRNVASDAIATYVASDNVSLGERSTELLLQFMADQESKDTYNVVELQGTTGASVTNDRGEGFGNVVDENAIEVLGSQTGEFATQAALNVMEDFITQHGDDIDGAFCHNDLMALGVHQAVQGSDIGPIPITGIDGTEGWVELFGDNQYYGTIAQLPEEMVNTAIERGQTAVEGESLEDYYQVDGLEVTQDNASDYLDEYF

SEQ ID NO: 1724 - protein, 359 aa, Haloarcula sp. JP-L23
MPRDIPRRRFIRTSAIAGTALIAGCGGDGGDGGDGGGDGATGTTETTGDGGDGDGDGGTETEETTQSTDAPSVALSVPSLEFTFFARMQNAFDAAKSEGTIASDSTFYDAGNSQSTQVSDVETAISNEVDLLLISAITAEGVISAIQQANDAGIPVVAIDRNVAEGDTVSYVASDNVQLGRRSTELCLSFMQEMEQKDTYNVLQLEGTPGASVTNDRGEGFSNAVSNNDSLSRLASQTGEFSTQNALSVMEDFITQYGDEIDGVFCQNDLMALGAHRALQNANMSVPVTGIDGTEAWVQLFSDNQYYGTIAQLPEEMVNTAIETGKAHLAGEDVQETVVIDGLEVTQDNAADYLGQYFG

SEQ ID NO: 1725 - protein, 362 aa, Halobacteriales archaeon QH_6_64_20
MSRDLRRRQFIRSGTIAGAAVLAGCTGGGSDGGGNGSSGGNNASESGNGDDSSASNGSSANESGGSSSNSESPPTVALSIPSLEFTFFARMQEVFEQAKNQGTIASDSSFYDAGDSQSTQISNVETAISNDVAFLMISAITAEGVVNAINEANQNDIPVIAIDRNVAEGETVTYIASDNVQLGQRSTELCLNFMQESADMDTYSVVQLSGTPGASVTNERGQGFRNVVSNNSNLEALASQTGEFTTQDALSTMEDFITQYGDEIDGVFCQNDLMALGARQALQSSNMSVPITGIDGTRAWVELFADNQYYGTLAQLPEEMVTTAIERGKAYLAGEEVEDVIPIDGLEVTQENAADYIDQYFG

SEQ ID NO: 1726 - protein, 338 aa, Altiarchaeales archaeon WOR_SM1_79
MKKSRIFFVLLTVLFMLFSLQVVWAEGKKEEKPYFAFVTNGVNDFWILSQRGLEQAAKDFDVICDYRTPPNGTAAEQTSIVEDLLAKRVDGIAITIIDPDTMTPFLNEAAKKTFLITHDSDAPESDRICYIGTNNYSAGRTMGKLIKEVIPNGGELMLQVGKLDVLNAVERRQGIIDELKGLPVPEKYTVSPPGRVECEKWTILDTRIDNVDYGRAKQNAEDAIIRYPDIDLFVGLWAYEGPMILSALKDAGLEGKIPVCAFDELGETLQGITDGYIYGTVVQDPYNFGYKSVEMLYALYKGDRSMVPDDGIIYIPERVISKDNVKPFWDDMNKKLGK

SEQ ID NO: 1727 - protein, 347 aa, Methanospirillum lacunae
MSVRYSISALFTCILVLLIIPAICPGETPVNQNSTEQTILGLIPSGNTSPFHQELIKGVIDEAANHNWTVITIPPDSEENITSQKLAMWDLINRNARIICLNTLNTSALTPEIKAATEAGIPVVLYNTLTPAQKMNISEYIGYNQYTGSAELGSYASRILAEKKNEAPDTIQGKVFILRGLPGFHADQRTAGFITGLTQSHGITIADQKVAGWDRDTAKTIALQALKDHPDLSIFYGNNDEMAIGAAMAVLDRGKKVNSDLLCIGIDGNTPTLDMIRNGTMTATLGVYPYKMGSTVVKQAVKILNGEQVPMYLETPSTVVDINNLDAYLNGSTWTDPIESVAEKEIK

SEQ ID NO: 1728 - protein, 347 aa, Altiarchaeales archaeon WOR_SM1_79; identical to SEQ ID NO: 1727

SEQ ID NO: 1729 - protein, 414 aa, Halobacteriales archaeon QS_8_65_32
MADDSTSTVSRRTALKALGTSGAVALAGCLGGGGSGSEQTDSGGGGNGSGGGANSSGGGGGESDSGGGGGSGGEQPNYPHTIWGMYGSWEDAYVQGGKFFARDKGFEFENYNSRGEGQEQISQIQSFVQQGADGIAVGPVSATAPASAIENAASQDIPVISCNSDIETPDLSMSIYIGNEPATQAVGEAIVKQLRSDGSGNSAEGTVLDLQGDLAQSIGASREQGFRNAVNGVSGIEVLEARANFNQGPAQEGTFAQLQSTGGNIDAIFAANGAMAAGAAEALDRYGSQPGDVFMGCMDGSPTVIDLFDEGWLQRGYAQPTQYYLPIALHYLDLLRTEGEGALPSPGDELTTDDLSISGQQHLGTDIWSGQDWAPATVREKNGHPWFQTSGKLLNSDNYDQSSNWGVIFSQDAV

SEQ ID NO: 1730 - protein, 408 aa, Halobacteriales archaeon QS_4_62_28
MTSRRKLLKGIGAASTITLAGCSGDGDGSGDDGDSSTDTADKSGDQGTTVGDSDGSSDDGQHFGISMKSMGQAGLFVQGLAGKWYTQDMDDVEITILDAQFDASKQTQDAINLINQGIDGLLLNPYDANASAQIAEKAAEEDVPVMNFDTATLSNDIKLGALFGQYRGGEVAAERFTDMMDEQGMDSAKVITSVFNFSSSTSQQRLYGFTENVPDGVEVVSRVESNGTAEDTAPKMQNALQANPDVDAIYSNNVGSGMGALQALDQFGQYYKKDHEDHVMSFGIDGGPELNQRIKSGYYDFAVDQPLHMYAPLTLELMWDYLEGGDDALPQVGDTVTPGEDLSLENKEVFGVKPWEEQFWGPAEMVEYEADDETWWPWMKCAHAMITEDNADASYLYGNVARAYEDQN

SEQ ID NO: 1731 - protein, 414 aa, Salinigranum rubrum
MTSRRNLLKGIGAAGIAGLAGCTGGQSGNQSSGGGSSGGGGGSSGGDGGSSEGTTVGDSGSSDSGTQRFAVSMKSMGQAGLFVQGQAAKWYTRDRDDVEIVILDAEFDASKQTQDAINAINQGLDGILLNPFDAKASRQIVEKATEEDIPVMNFDTATLSEDVVMGALFGQYAGGQVAGERFTQMIEEQGIEDPKVITSVFNFESTTSQARLYGFTENIPDSVEVVNRIESDGTPEDSAPQTQSALQANPDVDAIYSNNVGSGMGALTALQQMDMYHKKDSEDHVMAFGIDGGPELNQRIGSGYYDFAVDQPLHMYAPLTLELMWDYLENGESALPQVGDTVTPGENLSIENKTVEGIEPWSEQFWGPAEMTEYEAEDTAWWPWLKCQHAMITQENADASYLYGNVYREIEGSN

SEQ ID NO: 1732 - protein, 422 aa, Candidate division MSBL1 archaeon SCGC-AAA259D18
MDVAPTVDGEEIESETVEVESGETKDVEFTVTKEEAGNYTVSVHGRTTILEVTAEALEELLIGHSPLFTRDEFFRTLVRATQYYCQAHEGISQNWMNPHNTSAQQIKDMKYMIQQGVDGIIASPISASACASVVDTAYSQNIPTVTYNTDAPTKNVAATVMVNNETLGAAAAEALIEKMKKAGVELEGTAVIDGGDKTWPQAQARTRGFEKVFEEYPGLEIVKYWNEGWDMKKAKDKMTQYLIAHGKPLIAVGVNNTTNSGVIEALRAQDALVPRSQPNEHVWTAFIGLNSVVQEAMKNGYAEISSNQPNLIYGTLALYLVERCIRNGPTPLADPGDVPEPGDTVIADPSKPIGEIEEGTWNLALPKPTVLSGVDIAKQKWTPCPVVEKDGHPWIVTEPLVVEWDKAYTAPVYVNLAPKWLE

SEQ ID NO: 1733 - protein, 324 aa, Halobacteriales archaeon QH_8_68_33
GADGGDGGDGGDGDGGGDGDDGGDDTPTETATSEGPTTTALSVPSLEFTFFARMQNAFDAAKEGGIISEDSSFYGANDNSSQQVSDLETAITNEVDFIMVSAIREDAVVSTVEDAVDQGIPVVAIDRNVASDTIATYVASDNVSLGERSTELLLQFMADQESKDTYNVVELQGTTGASVTNDRGEGFGNVVDENAVEVLGSQTGEFATQTALNVMEDFITQHGDDIDGAFCHNDLMALGVHQAVQGSDIGPIPITGIDGTEGWVELFGDNQYYSTIAQLPEEMVNTAIERGQTAVEGESLEDYYRIDGLEVTQDNATDYLDEYF

SEQ ID NO: 1734 - protein, 388 aa, Halarchaeum acidiphilum MH1-52-1
MVTTLQNDQWQAFANGVQEAANALGAPDSDYKQNQGQQQKMVSQLSTAFTKGYNAICGTPYQASGVPTVVRKCKQNDAGFVDFWNIAKWYTPLDAGENFIQYQIPAVAKTGQLTAEILFEEMGGEGNFVHITGPHGVTGRNRNIGVENAMKKYPDINKLGMQPGDWSRPSGRKVMSSFVSKYGDKIDGVYCQNDAMGLGAYTILKNNDMSVPMVGYDGPKDAVNNIKSTSADGDGPNWVASFSAKTFWQGGYAVVEAFDWLNGWRPTVPERMMWGGGVVVTSDPSKYRGKLKTEFDASWSKPDDYLSVAYSDGKSPYDWKKMSRTLNPDGWDPQNKLVPIRKDEFNQLNWTESNKPSGYSLPDAYSESGTFDDVEQRYAKHHETDPYQ

SEQ ID NO: 1735 - protein, 331 aa, Beauveria bassiana D1-5
MNKKVLTLSAVMSCMLFGAAANAADRIGVTIYKYDDNFMSVVRKAIEKDAKASPDVQLLMNDSQNDQSKQNDQIDVLLAKGVKALAINLVDPAAAGTVIEKARAQNVPVVFFNKEPSRKALDSYDKAYYVGTDSKESGIIQGDLIAKHWAANPAWDLNKDGQIQFVLLKGEPGHPDAEARTTYVIKELNDKGLKTQQLQLDTAMWDTAQAKDKMDAWLSGPNANKIEVVIANNDAMAMGAVEALKAHNKTSIPVFGVDALPEALALVKSGAMAGTVLNDANNQAKATFDLAKNLADGKPAAEGTNWKIENKIVRVPYVGVDKDNLAQFIGK

SEQ ID NO: 1736 - protein, 336 aa, Monosporascus sp. 5C6A
MISRVLNTLAAAAVLTFAATSAHASKEAPVIGFSIDDLRVERWTHDRDYFVESAKKLGATVNVQSANANEAKQIAQIENLIAQNVDVLVIVPFNSKVLGNAIASAKKKGIKVVSYDRLILNADIDGYVTFDNVKVGELQAQGVVKLAPKGNYFLLGGAATDNNARLLREGQMKVLKPYVDKGDIKIVGEQWTPEWDPSKAQNIVENALTANNNNIQGIVASNDGTAGGAIQALARQKLAGKVPVSGQDADLAAVKRVAEGTQAMTVYKPIKQIAATAAEMAVDLVKGTAPKFNTKLNNGKKDVDTVLLTPTLLTKDNLDSTVVKDGFYTHQQIFGK

SEQ ID NO: 1737 - protein, 336 aa, Monosporascus sp. CRB-9-2
MISRVLNTLAAAAVLTFAATSAHASKEAPVIGFSIDDLRVERWPHDRDYFVESAKKLGATVNVQSANANEAKQIAQIENLIAQNVDVLVIVPFNSKVLGNAIASAKKKGIKVVSYDRLILNADIDGYVTFDNVKVGELQAQGVVKLAPKGNYFLLGGAATDNNARLLREGQMKVLKPYVDKGDIKIVGEQWTPEWDPSKAQNIVENALTANNNNIQGIVASNDGTAGGAIQALARQKLAGKVPVSGQDADLAAVKRVAEGTQAMTVYKPIKQIAATAAEMAVDLVKGTAPKFNTKLNNGKKDVDTVLLTPTLLTKDNLDSTVVKDGFYTHQQIFGK

SEQ ID NO: 1738 - protein, 309 aa, Beauveria bassiana D1-5
MKKLILAALIALTTAPALAENEQIVFSTPNLAMPFEVHMQRTAVQAAKEMGVKLQVLDSQGSSPKQVADLENAITRGAQGFIVSPNDVNAVSSAVGEIQDAKLPVVTLDRSVASDKPVPHFGANNYKGGQAVADFVKAKFPDGADIVLLTGQPGSSSNIERTKGIRDGLKAGGDKYKIVADQTGNWMRSEGMRIVESVLPSLPKKPQVILSANDDMALGAIEALQGQGMKPGEVLVTGFDAVPEALARVRDGWMAATADQRPGFAVKTAMSQLVANIREKKAITGADYAPTMITKDNLDQAERIGEAGK

SEQ ID NO: 1739 - protein, 325 aa, Beauveria bassiana D1-5
MSRLTRKSFFAVLMLLSASSASLAAGKEITVGAIYLDTQGYYAGVRQGVQDAAKSSDVKVQLIETNAQGDISKESSFVDTLVARNVDAIILSAVSENGSTRTIRRASEAGIPVICYNTCINQKGVETYISAYLVGDPLEFGKKLGNAAADYFIAHNIAAPKIAIINCEAFEVCVQRRKGFEEALKARVPGMQIVANQEGTVLDKAISVGEKLIVSSQNLDAIMGESGGATLGAVKAVRNQNKVGKIAVFGSDMTTEIAQELQNNQVLKAVVDISGKKMGNAVFAQTVDVINKNPPKEKITQVPIDLYSKAEDGKQWLATHVDGLP

SEQ ID NO: 1740 - protein, 736 aa, Beauveria bassiana D1-5
MQTVGILPILVLIIAVFGFVAPNFFTESNLLNIARQSSINIVLAAGMTFIILTGGIDLSVGSILGTTAVTAMVVSLMPGWEGLSIPAALLMGTGLGLFNGMLVAWAGLPPFIVTLGTYTALRGAAYLLADGTTVINSNINFEWIGNAYLGPVPWLVVIALLVIAVCWFILRRTTLGVHIYAVGGNMQAARLTGIKVWMVLLFVYGMSGLLSGLGGIMSASRLYSANGNLGVGYELDAIAAVILGGTSFVGGIGTITGTLVGALIIATLNNVTALLAGAMIAGAPFAQAKELKSIGVTVGDLANPFFVQITKGAELEARKLAGDNVKVTLVSSGYDLGQQVAQIDNFIAAKVDMIILNAADSKGIGPAVKRAKDAGIVVVAVDVAADGADATITSDNTQAGQMACKYISDRLKDKGNVVIINGPPVSAVQNRVEGCETEFKKHPDIKILSSNQNAKGSREGGLEVMTSLLAANPKIDGVFAINDPTAIGADLAAKQAQRNEFFIVGVDGSPDGEEALKRGGSSLFVATPAQDPQVMAAKAVEIGYDILQGKPAPKGPVLIPVTMIDKSNIGSYKGWTVNWQEVFDLKLGWDITDFGGSDFLTMGLTLFTLRNGSPEGTPYAKSYAEKVMHVRDNQMTPMHFHWSKQEDIINRGGGNLIVELWHSDPFEQPDEADITVVIDGCRQTHAAGSQLRLSPGESISLVPEMYHSFWGEPGYGDVLVGEHPYRRCRPGSAFVP

SEQ ID NO: 1741 - protein, 342 aa, Monosporascus sp. 5C6A
MRSNQRRCVLRAAVCGAVLASLSMTVPLAHASKAHPEIGFCIDDLRVERWSRDRDYFVAAAEKLGAKVSVQSADASEQRQISQIENLISRGVDVIVIVPFNSKALTNVVAEAKKAGIKVVSYDRLILDADVDAYISFDNEKVGELQAQGVFNVRPKGNYFLLGGAPTDNNAKMLRQGQLKVLQPAIDRGDIKVVGSQWVPEWSASAALGIVENALTANNNKIDAVVASNDGTAGGAIQALAAQKLAGKVPVSGQDADLAAVKRVIAGTQTMTVYKPLKLIATEAAQLSVALAKGDKPKYNAQYDYGKKKVDTVLLQPTQLTKDNVNLVVKDGFYTQAQIGGQ

SEQ ID NO: 1742 - protein, 300 aa, Beauveria bassiana D1-5
MLASIGFISAAGAAAPTYALVQINQQALFFNLMNKGAADAAKSSGKNLVIFNSNDNPVAQNDAIENYIQQGVKGILVDAIDVNGIMPAIKEAAAANIPVIAIDAVLPAGPQAAQVGVDYIEGGKIIGKYFVDYVQKEMGGQARLGIVGALNSAIQNQRQKGFEEMLKSNPKITIADVVDGQNVQDKAMIAAENLITGNPDLTVIYATGEPALLGAIAAVENQGRQKDIKVFGWDLTAKAISGIDGGYVTAVLQQDPEKMGAEALKALNAITSGKTVPKTILVPATVVTKANVDTYRSLFK

SEQ ID NO: 1743 - protein, 179 aa, Beauveria bassiana D1-5
MGGSPVDNNAKLFRAGQMKVLKPYIDEGKIKVVGDQWVDGWLPENALKIMENALTANNNKIDAVVASNDATAGGAIQALSAQGLAGKVAISGQDADLAGIKRIIAGTQTMTVYKPITKLADTAAEIAVELGEGKQPAADATLNNGLKDVPSRLLTPIEVEKTNIDSTVIADGFHKKSDL

SEQ ID NO: 1744 - protein, 259 aa, Ricinus communis
MLKLLTTSAVALVLASQAHAADRIGVSMGTLSNNFQTLIVNGMEDYAKSIGVELQIEDATTDVNKQLDQVKNFAAGGVSAIIVDPVDSDGTPALSKVAEDAGIPLIYVNVQPTDLNTLGKQQAFVGSNENESGTLQTKEVCRMLGGKGNVVIMIGDLTSQAARQRTQDVYDVVKTPECSGINVAQEQVGNWSRVNGADLVSNWLTSGVEFDAIIANNDEMALGAISALKAAGASTDKIIVSGIDATPEALQAMKTGDLK

SEQ ID NO: 1745 - protein, 346 aa, Spinacia oleracea
MNSFAKLLAGTAVLVSLHTAAIAADLVVGVSWSNFQEERWKTDEAAIKAALDKAGAKYISADAQSSAAKQLTDVESLISQGANALIILAQDSDAIGPAVEKAVAEGIPVVGYDRLIENQNAFYITFDNKEVGRLQAAEVFKVKPEGNYVFIKGSSSDPNADFLFAGQQEVLKAAIDGGKIKNVGEAYTDGWKPENAQKNMEQFLTKNNNKVDAVVASNDGTAGGAIAALAAQGMAGSVPVSGQDADFAALNRVALGTQTVSVWKDSRELGKEAAGIALELAGGKKMTEIKGVTSFDGGPKKVAMQSVFLKPIAITKDNLGTVIDAGWIKKETACQGVKAGTVKACD

SEQ ID NO: 1746 - protein, 369 aa, Beta vulgaris
MPTKSSARWIADGDNMVKVLKDRGYKTDLQYAEDDIPNQLAQIENMITKGAKVLVIASIDGTTLSKALQNAADKGVKVIAYDRLIKGSKNVDYYATFDNFQVGVLQATSIVDKLGLKQGKGPFNIELFGGSPDDNNAFFFYDGAMSVLQPYIDSGKLVVRSKQTGMNKVGTLRWDGSVAQARMDNLLSAYYGKDKVHAVLSPYDGISIGILSSLKGVGYCTAQQPCPVVSGQDAEVPSIKSILKGEQSSTVFKDTRELAKVAANMVDAVLTGKQPEINDTKTYNNGVKVVPSYLLKPVAVDSSNWNAVLVGSGYYKESQIKCVPAWQLQRPDPVRRAGARIRGHPRQRAPGHHHHSPGAGAGAAAVDCR

What is claimed is:

1. A device for detecting the presence of an analyte in a subject, the device comprising:
   a light transmissive material configured to receive an excitation wavelength of light from a light source;
   a waveguide comprising a cladding layer that surrounds a core material, the waveguide being configured to receive the excitation wavelength of light via a proximal end of the waveguide and to transmit the excitation wavelength of light along the waveguide to a distal end of the waveguide, the distal end of the waveguide extending from the device, the distal end configured to penetrate the skin of the subject and reside in the dermis of the subject;
   a flange coupled to the waveguide and configured to allow the distal end to penetrate to the dermis of the patient;
   an adhesive layer contacting the flange, the adhesive layer configured to secure the device to the skin of the patient; and
   an indicator compound comprising a fusion protein, the indicator compound being disposed within the waveguide and being configured to receive the excitation wavelength;

wherein the fusion protein comprises:
a luminescent protein domain; and
an analyte binding protein domain;
wherein, when the analyte binds to the analyte binding protein domain, the indicator compound undergoes a conformational change from a first conformation to a second conformation;
wherein, when in the second conformation, the indicator compound is configured to receive the excitation wavelength and to emit a luminescent signal;
wherein the luminescent signal is received by the waveguide and transmitted to the light transmissive material;
wherein the light transmissive material is configured to deliver the luminescent signal to a luminescence detector.

2. The device of claim 1, wherein the waveguide further comprises a protective polymer layer over the cladding layer.

3. The device of claim 1, wherein the indicator compound is distributed in the core of the waveguide, at the interface of the core and the cladding layer of the waveguide, in the cladding layer of the waveguide, at the surface of the cladding layer of the waveguide, or combinations of any of the foregoing.

4. The device of claim 1, wherein the luminescent protein is a split luminescent protein.

5. The device of claim 1, wherein the indicator compound shares 80% to 100% identity, homology, or similarity to one or more of SEQ ID NOs: 3-13 or 16-20.

6. The device of claim 1, wherein the analyte binding protein domain is a domain of a periplasmic protein.

7. The device of claim 1, wherein the analyte binding domain shares 80% to 100% identity, homology, or similarity to one of SEQ ID NOs: 2, 15, 122-221, or 824-1746.

8. The device of claim 1, wherein the luminescent protein domain is a domain of a fluorescent protein.

9. The device of claim 1, wherein the luminescent protein domain shares 80% to 100% identity, homology, or similarity to one or more of SEQ ID NOs: 1, 14, 34-121, or 222-823.

10. The device of claim 1, wherein the waveguide is a biocompatible step-index fiber optical waveguide.

11. The device of claim 1, wherein the waveguide comprises a fiber having a first refractive index and wherein the cladding layer has a second refractive index, wherein the first and second refractive indices are different.

12. The device of claim 1, wherein the waveguide comprises one or more of a polyethylene glycol (PEG), an alginate hydrogel, a polyacrylamide hydrogel, an alginate-polyacrylamide hydrogel, a silk, a citrate-based polymeric elastomer, or a combination thereof.

13. The device of claim 1, wherein the light transmissive material comprises a notch configured to receive the flange and waveguide.

14. A method for detecting an analyte in a patient comprising:
selecting a patient in need of analyte monitoring;
inserting into or attaching the device of claim 1 to the patient;
applying the excitation wavelength of light to the indicator compound.

15. The method of claim 14, further comprising collecting the luminescent signal from the device.

16. The method of claim 14, further comprising comparing the luminescent signal to a reference signal indicative of an indicator compound without an analyte bound.

17. The method of claim 14, further comprising quantifying an amount of luminescent signal as a concentration of analyte.

* * * * *